United States Patent 11,421,016 (CANCER NEOEPITOPES) - sequence listing, part 31

SEQ ID NO: 1380425 - protein, 9 aa, Homo Sapiens
EVVGEGLIP

SEQ ID NO: 1380426 - protein, 9 aa, Homo Sapiens
ESVTTVANF

SEQ ID NO: 1380427 - protein, 9 aa, Homo Sapiens
GDGNKKPAS

SEQ ID NO: 1380428 - protein, 9 aa, Homo Sapiens
NILQPVLAD

SEQ ID NO: 1380429 - protein, 9 aa, Homo Sapiens
TVTTSGFSE

SEQ ID NO: 1380430 - protein, 9 aa, Homo Sapiens
QIAQELEER

SEQ ID NO: 1380431 - protein, 9 aa, Homo Sapiens
RKASVVVAV

SEQ ID NO: 1380432 - protein, 9 aa, Homo Sapiens
RSLKGAMAQ

SEQ ID NO: 1380433 - protein, 9 aa, Homo Sapiens
NAAPRPANY

SEQ ID NO: 1380434 - protein, 9 aa, Homo Sapiens
DAGMYTCAG

SEQ ID NO: 1380435 - protein, 9 aa, Homo Sapiens
LFTSALLPV

SEQ ID NO: 1380436 - protein, 9 aa, Homo Sapiens
DMVYVAQSA

SEQ ID NO: 1380437 - protein, 9 aa, Homo Sapiens
VFMCPQGSP

SEQ ID NO: 1380438 - protein, 9 aa, Homo Sapiens
RRIPINTDI

SEQ ID NO: 1380439 - protein, 9 aa, Homo Sapiens
VQILHSRVQ

SEQ ID NO: 1380440 - protein, 9 aa, Homo Sapiens
PGPHHSLPA

SEQ ID NO: 1380441 - protein, 9 aa, Homo Sapiens
LGASGQESE

SEQ ID NO: 1380442 - protein, 9 aa, Homo Sapiens
DFHYKTVDG

SEQ ID NO: 1380443 - protein, 9 aa, Homo Sapiens
ASVYHEKIL

SEQ ID NO: 1380444 - protein, 9 aa, Homo Sapiens
QARELPLQR

SEQ ID NO: 1380445 - protein, 9 aa, Homo Sapiens
ELLPNCIPH

SEQ ID NO: 1380446 - protein, 9 aa, Homo Sapiens
QRPQTDEEG

SEQ ID NO: 1380447 - protein, 9 aa, Homo Sapiens
FTTRKEHWI

SEQ ID NO: 1380448 - protein, 9 aa, Homo Sapiens
VAAGPPMRE

SEQ ID NO: 1380449 - protein, 9 aa, Homo Sapiens
GESSHKEDT

SEQ ID NO: 1380450 - protein, 9 aa, Homo Sapiens
QACSPSYTG

SEQ ID NO: 1380451 - protein, 9 aa, Homo Sapiens
TPPKCPGGR

SEQ ID NO: 1380452 - protein, 9 aa, Homo Sapiens
YKKDFGKND

SEQ ID NO: 1380453 - protein, 9 aa, Homo Sapiens
VPVSEASIT

SEQ ID NO: 1380454 - protein, 9 aa, Homo Sapiens
TRTVPTTFT

SEQ ID NO: 1380455 - protein, 9 aa, Homo Sapiens
SREDWGGPE

SEQ ID NO: 1380456 - protein, 9 aa, Homo Sapiens
LSGLLDALL

SEQ ID NO: 1380457 - protein, 9 aa, Homo Sapiens
LESVRQIYS

SEQ ID NO: 1380458 - protein, 9 aa, Homo Sapiens
ITGDLEEMR

SEQ ID NO: 1380459 - protein, 9 aa, Homo Sapiens
TISHSPLQP

SEQ ID NO: 1380460 - protein, 9 aa, Homo Sapiens
HPTIVCLPG

SEQ ID NO: 1380461 - protein, 9 aa, Homo Sapiens
GAPRFSSVV

SEQ ID NO: 1380462 - protein, 9 aa, Homo Sapiens
KCCDYETAE

SEQ ID NO: 1380463 - protein, 9 aa, Homo Sapiens
HTMPFWRIS

SEQ ID NO: 1380464 - protein, 9 aa, Homo Sapiens
PDTKKNSIG

SEQ ID NO: 1380465 - protein, 9 aa, Homo Sapiens
EKYIMTCLY

SEQ ID NO: 1380466 - protein, 9 aa, Homo Sapiens
RQLEKISTT

SEQ ID NO: 1380467 - protein, 9 aa, Homo Sapiens
ITVLGGEVE

SEQ ID NO: 1380468 - protein, 9 aa, Homo Sapiens
AHKLALEPG

SEQ ID NO: 1380469 - protein, 9 aa, Homo Sapiens
AVFECEVVN

SEQ ID NO: 1380470 - protein, 9 aa, Homo Sapiens
LWMLARSSR

SEQ ID NO: 1380471 - protein, 9 aa, Homo Sapiens
LMSTATFLA

SEQ ID NO: 1380472 - protein, 9 aa, Homo Sapiens
GPLVLKLLG

SEQ ID NO: 1380473 - protein, 9 aa, Homo Sapiens
GPSEAPGQT

SEQ ID NO: 1380474 - protein, 9 aa, Homo Sapiens
VDIVTGGVS

SEQ ID NO: 1380475 - protein, 9 aa, Homo Sapiens
ELTEEEGKA

SEQ ID NO: 1380476 - protein, 9 aa, Homo Sapiens
FSELSFPLG

SEQ ID NO: 1380477 - protein, 9 aa, Homo Sapiens
LWHRELQRP

SEQ ID NO: 1380478 - protein, 9 aa, Homo Sapiens
EHKKKHWEK

SEQ ID NO: 1380479 - protein, 9 aa, Homo Sapiens
PAVPVKRWS

SEQ ID NO: 1380480 - protein, 9 aa, Homo Sapiens
SPLQPVCAT

SEQ ID NO: 1380481 - protein, 9 aa, Homo Sapiens
LKKIFALLE

SEQ ID NO: 1380482 - protein, 9 aa, Homo Sapiens
PLNSTETSK

SEQ ID NO: 1380483 - protein, 9 aa, Homo Sapiens
VDGDVFRFP

SEQ ID NO: 1380484 - protein, 9 aa, Homo Sapiens
MYTCAGTNM

SEQ ID NO: 1380485 - protein, 9 aa, Homo Sapiens
YRERGGGCL

SEQ ID NO: 1380486 - protein, 9 aa, Homo Sapiens
LSTIALTLG

SEQ ID NO: 1380487 - protein, 9 aa, Homo Sapiens
FKKGSWCLF

SEQ ID NO: 1380488 - protein, 9 aa, Homo Sapiens
SIRWGADAY

SEQ ID NO: 1380489 - protein, 9 aa, Homo Sapiens
LSCKDCMKG

SEQ ID NO: 1380490 - protein, 9 aa, Homo Sapiens
TSMMSGGRC

SEQ ID NO: 1380491 - protein, 9 aa, Homo Sapiens
VPQQRLGEL

SEQ ID NO: 1380492 - protein, 9 aa, Homo Sapiens
REGKGKSQL

SEQ ID NO: 1380493 - protein, 9 aa, Homo Sapiens
IRCPAELPA

SEQ ID NO: 1380494 - protein, 9 aa, Homo Sapiens
AYAATRDNC

SEQ ID NO: 1380495 - protein, 9 aa, Homo Sapiens
QQEVVDTTG

SEQ ID NO: 1380496 - protein, 9 aa, Homo Sapiens
WTCSAPATV

SEQ ID NO: 1380497 - protein, 9 aa, Homo Sapiens
WQVFLKMIL

SEQ ID NO: 1380498 - protein, 9 aa, Homo Sapiens
RVGANSTCW

SEQ ID NO: 1380499 - protein, 9 aa, Homo Sapiens
GGRCALLAT

SEQ ID NO: 1380500 - protein, 9 aa, Homo Sapiens
GETHESHVV

SEQ ID NO: 1380501 - protein, 9 aa, Homo Sapiens
ITTPPLPPR

SEQ ID NO: 1380502 - protein, 9 aa, Homo Sapiens
SRGSVHPDK

SEQ ID NO: 1380503 - protein, 9 aa, Homo Sapiens
FLSTNNAFS

SEQ ID NO: 1380504 - protein, 9 aa, Homo Sapiens
FVAEYIDSN

SEQ ID NO: 1380505 - protein, 9 aa, Homo Sapiens
MTPAAAPSS

SEQ ID NO: 1380506 - protein, 9 aa, Homo Sapiens
NCPSKKTKR

SEQ ID NO: 1380507 - protein, 9 aa, Homo Sapiens
SARACDSIT

SEQ ID NO: 1380508 - protein, 9 aa, Homo Sapiens
CLYKYVFCP

SEQ ID NO: 1380509 - protein, 9 aa, Homo Sapiens
VVVTYFVFV

SEQ ID NO: 1380510 - protein, 9 aa, Homo Sapiens
AGHTHSSAQ

SEQ ID NO: 1380511 - protein, 9 aa, Homo Sapiens
AAGPPMREV

SEQ ID NO: 1380512 - protein, 9 aa, Homo Sapiens
ENSLPPKKI

SEQ ID NO: 1380513 - protein, 9 aa, Homo Sapiens
GPNKGFDLC

SEQ ID NO: 1380514 - protein, 9 aa, Homo Sapiens
AWMFFLVSC

SEQ ID NO: 1380515 - protein, 9 aa, Homo Sapiens
IALVMQTEI

SEQ ID NO: 1380516 - protein, 9 aa, Homo Sapiens
KQKKNEPRM

SEQ ID NO: 1380517 - protein, 9 aa, Homo Sapiens
DGENRRIPI

SEQ ID NO: 1380518 - protein, 9 aa, Homo Sapiens
AQIHQERRL

SEQ ID NO: 1380519 - protein, 9 aa, Homo Sapiens
TSSYGTIIM

SEQ ID NO: 1380520 - protein, 9 aa, Homo Sapiens
YQDPDGENK

SEQ ID NO: 1380521 - protein, 9 aa, Homo Sapiens
DDFLEKKWS

SEQ ID NO: 1380522 - protein, 9 aa, Homo Sapiens
VPPQEGPHI

SEQ ID NO: 1380523 - protein, 9 aa, Homo Sapiens
KKKHWEKEM

SEQ ID NO: 1380524 - protein, 9 aa, Homo Sapiens
HGDEAAWTG

SEQ ID NO: 1380525 - protein, 9 aa, Homo Sapiens
MAAVKTCRW

SEQ ID NO: 1380526 - protein, 9 aa, Homo Sapiens
VWGLKKIFA

SEQ ID NO: 1380527 - protein, 9 aa, Homo Sapiens
RRGWRPLRK

SEQ ID NO: 1380528 - protein, 9 aa, Homo Sapiens
MILQQPLRR

SEQ ID NO: 1380529 - protein, 9 aa, Homo Sapiens
EVLKKKTGS

SEQ ID NO: 1380530 - protein, 9 aa, Homo Sapiens
IARSIARAR

SEQ ID NO: 1380531 - protein, 9 aa, Homo Sapiens
AQENQGGVP

SEQ ID NO: 1380532 - protein, 9 aa, Homo Sapiens
RPQTDEEGS

SEQ ID NO: 1380533 - protein, 9 aa, Homo Sapiens
EDEQSNHTT

SEQ ID NO: 1380534 - protein, 9 aa, Homo Sapiens
RPVATLSPG

SEQ ID NO: 1380535 - protein, 9 aa, Homo Sapiens
AQQDVLRTR

SEQ ID NO: 1380536 - protein, 9 aa, Homo Sapiens
DSSYTKILQ

SEQ ID NO: 1380537 - protein, 9 aa, Homo Sapiens
MVAFLILFT

SEQ ID NO: 1380538 - protein, 9 aa, Homo Sapiens
WSPASGSGL

SEQ ID NO: 1380539 - protein, 9 aa, Homo Sapiens
EKRQAVNMM

SEQ ID NO: 1380540 - protein, 9 aa, Homo Sapiens
GARSSCEDP

SEQ ID NO: 1380541 - protein, 9 aa, Homo Sapiens
RIRLGLKEF

SEQ ID NO: 1380542 - protein, 9 aa, Homo Sapiens
SVGVDGEIV

SEQ ID NO: 1380543 - protein, 9 aa, Homo Sapiens
VDRTNHQVH

SEQ ID NO: 1380544 - protein, 9 aa, Homo Sapiens
PRECKLGAS

SEQ ID NO: 1380545 - protein, 9 aa, Homo Sapiens
VVLARESLG

SEQ ID NO: 1380546 - protein, 9 aa, Homo Sapiens
SIETDRGGA

SEQ ID NO: 1380547 - protein, 9 aa, Homo Sapiens
LSLNYFLMC

SEQ ID NO: 1380548 - protein, 9 aa, Homo Sapiens
PVTLVRPLW

SEQ ID NO: 1380549 - protein, 9 aa, Homo Sapiens
CPEKCRCES

SEQ ID NO: 1380550 - protein, 9 aa, Homo Sapiens
VFSVLSVIY

SEQ ID NO: 1380551 - protein, 9 aa, Homo Sapiens
DNTPGISQY

SEQ ID NO: 1380552 - protein, 9 aa, Homo Sapiens
RERDFTPSL

SEQ ID NO: 1380553 - protein, 9 aa, Homo Sapiens
IRVQLLNYV

SEQ ID NO: 1380554 - protein, 9 aa, Homo Sapiens
SKKTKRATT

SEQ ID NO: 1380555 - protein, 9 aa, Homo Sapiens
QQRHQRNAA

SEQ ID NO: 1380556 - protein, 9 aa, Homo Sapiens
GSPPPSQTA

SEQ ID NO: 1380557 - protein, 9 aa, Homo Sapiens
AAGRGHGEV

SEQ ID NO: 1380558 - protein, 9 aa, Homo Sapiens
SEHNYCRLI

SEQ ID NO: 1380559 - protein, 9 aa, Homo Sapiens
AQSAGRLMR

SEQ ID NO: 1380560 - protein, 9 aa, Homo Sapiens
LSINPVKQE

SEQ ID NO: 1380561 - protein, 9 aa, Homo Sapiens
GKAFIWSPT

SEQ ID NO: 1380562 - protein, 9 aa, Homo Sapiens
DLGRRGWRP

SEQ ID NO: 1380563 - protein, 9 aa, Homo Sapiens
IMNDTHVDE

SEQ ID NO: 1380564 - protein, 9 aa, Homo Sapiens
GMLENYRNL

SEQ ID NO: 1380565 - protein, 9 aa, Homo Sapiens
AQDRAGVTS

SEQ ID NO: 1380566 - protein, 9 aa, Homo Sapiens
PALGVVLAR

SEQ ID NO: 1380567 - protein, 9 aa, Homo Sapiens
RVEVAAGPP

SEQ ID NO: 1380568 - protein, 9 aa, Homo Sapiens
PGRVGGSHQ

SEQ ID NO: 1380569 - protein, 9 aa, Homo Sapiens
WGGESSGDS

SEQ ID NO: 1380570 - protein, 9 aa, Homo Sapiens
FHYKTVDGD

SEQ ID NO: 1380571 - protein, 9 aa, Homo Sapiens
VLARESLGT

SEQ ID NO: 1380572 - protein, 9 aa, Homo Sapiens
GEIVYAKST

SEQ ID NO: 1380573 - protein, 9 aa, Homo Sapiens
GQTPELAGG

SEQ ID NO: 1380574 - protein, 9 aa, Homo Sapiens
RLCHVTTGK

SEQ ID NO: 1380575 - protein, 9 aa, Homo Sapiens
ARSSRASLW

SEQ ID NO: 1380576 - protein, 9 aa, Homo Sapiens
ACSTRTVPT

SEQ ID NO: 1380577 - protein, 9 aa, Homo Sapiens
PQWLHQQTE

SEQ ID NO: 1380578 - protein, 9 aa, Homo Sapiens
SMMSGGRCA

SEQ ID NO: 1380579 - protein, 9 aa, Homo Sapiens
TCSHIKEKL

SEQ ID NO: 1380580 - protein, 9 aa, Homo Sapiens
GPCPENSLP

SEQ ID NO: 1380581 - protein, 9 aa, Homo Sapiens
DGGDHGVWA

SEQ ID NO: 1380582 - protein, 9 aa, Homo Sapiens
ENLLLGANL

SEQ ID NO: 1380583 - protein, 9 aa, Homo Sapiens
ISLSGPRML

SEQ ID NO: 1380584 - protein, 9 aa, Homo Sapiens
LGARSSCED

SEQ ID NO: 1380585 - protein, 9 aa, Homo Sapiens
RLGRGRRGQ

SEQ ID NO: 1380586 - protein, 9 aa, Homo Sapiens
APLEQHTVC

SEQ ID NO: 1380587 - protein, 9 aa, Homo Sapiens
PRQAQCLLR

SEQ ID NO: 1380588 - protein, 9 aa, Homo Sapiens
ALHPGLAVP

SEQ ID NO: 1380589 - protein, 9 aa, Homo Sapiens
PQLHRIIGA

SEQ ID NO: 1380590 - protein, 9 aa, Homo Sapiens
ARESLGTAW

SEQ ID NO: 1380591 - protein, 9 aa, Homo Sapiens
SLGSFVAMP

SEQ ID NO: 1380592 - protein, 9 aa, Homo Sapiens
GETHSHSLK

SEQ ID NO: 1380593 - protein, 9 aa, Homo Sapiens
DFGKNDCKF

SEQ ID NO: 1380594 - protein, 9 aa, Homo Sapiens
DYVPSLMAR

SEQ ID NO: 1380595 - protein, 9 aa, Homo Sapiens
AVSVETRLN

SEQ ID NO: 1380596 - protein, 9 aa, Homo Sapiens
LSSIFFELE

SEQ ID NO: 1380597 - protein, 9 aa, Homo Sapiens
YGSGRLFIL

SEQ ID NO: 1380598 - protein, 9 aa, Homo Sapiens
WGAQALMPP

SEQ ID NO: 1380599 - protein, 9 aa, Homo Sapiens
TFPRESCLL

SEQ ID NO: 1380600 - protein, 9 aa, Homo Sapiens
ITSNVLPLL

SEQ ID NO: 1380601 - protein, 9 aa, Homo Sapiens
HYKTVDGDV

SEQ ID NO: 1380602 - protein, 9 aa, Homo Sapiens
IWQVFLKMI

SEQ ID NO: 1380603 - protein, 9 aa, Homo Sapiens
GPHRPSCYS

SEQ ID NO: 1380604 - protein, 9 aa, Homo Sapiens
EEEKEDPEL

SEQ ID NO: 1380605 - protein, 9 aa, Homo Sapiens
ELPLQRQQI

SEQ ID NO: 1380606 - protein, 9 aa, Homo Sapiens
TQENICQIF

SEQ ID NO: 1380607 - protein, 9 aa, Homo Sapiens
IFFIDHSPR

SEQ ID NO: 1380608 - protein, 9 aa, Homo Sapiens
CGPKEDAGD

SEQ ID NO: 1380609 - protein, 9 aa, Homo Sapiens
LEKLWNGEL

SEQ ID NO: 1380610 - protein, 9 aa, Homo Sapiens
ARNREYFRF

SEQ ID NO: 1380611 - protein, 9 aa, Homo Sapiens
APRSSCRAV

SEQ ID NO: 1380612 - protein, 9 aa, Homo Sapiens
PNGHFVCVL

SEQ ID NO: 1380613 - protein, 9 aa, Homo Sapiens
FAQDCKQSS

SEQ ID NO: 1380614 - protein, 9 aa, Homo Sapiens
RHLLCHGQV

SEQ ID NO: 1380615 - protein, 9 aa, Homo Sapiens
FGILIKRQQ

SEQ ID NO: 1380616 - protein, 9 aa, Homo Sapiens
HVDEDLKAI

SEQ ID NO: 1380617 - protein, 9 aa, Homo Sapiens
DNCQAFIKF

SEQ ID NO: 1380618 - protein, 9 aa, Homo Sapiens
SIEEFSIVR

SEQ ID NO: 1380619 - protein, 9 aa, Homo Sapiens
ELAFRKGGV

SEQ ID NO: 1380620 - protein, 9 aa, Homo Sapiens
EETGFHHVG

SEQ ID NO: 1380621 - protein, 9 aa, Homo Sapiens
ATSSPTRRR

SEQ ID NO: 1380622 - protein, 9 aa, Homo Sapiens
CVTSCCRPS

SEQ ID NO: 1380623 - protein, 9 aa, Homo Sapiens
AEVGKCLAD

SEQ ID NO: 1380624 - protein, 9 aa, Homo Sapiens
LRLRQLEKI

SEQ ID NO: 1380625 - protein, 9 aa, Homo Sapiens
TYHKEAHNS

SEQ ID NO: 1380626 - protein, 9 aa, Homo Sapiens
VYFSQAVGR

SEQ ID NO: 1380627 - protein, 9 aa, Homo Sapiens
LGKGNKSLD

SEQ ID NO: 1380628 - protein, 9 aa, Homo Sapiens
ENSSTPKRE

SEQ ID NO: 1380629 - protein, 9 aa, Homo Sapiens
RFCAERQDN

SEQ ID NO: 1380630 - protein, 9 aa, Homo Sapiens
VNPWYVLLC

SEQ ID NO: 1380631 - protein, 9 aa, Homo Sapiens
REPEREKPG

SEQ ID NO: 1380632 - protein, 9 aa, Homo Sapiens
IDIFFCANV

SEQ ID NO: 1380633 - protein, 9 aa, Homo Sapiens
HIVALDRDF

SEQ ID NO: 1380634 - protein, 9 aa, Homo Sapiens
SLPAEPCPR

SEQ ID NO: 1380635 - protein, 9 aa, Homo Sapiens
PVNGVINIL

SEQ ID NO: 1380636 - protein, 9 aa, Homo Sapiens
PGTRSRFFL

SEQ ID NO: 1380637 - protein, 9 aa, Homo Sapiens
PDAVVASSS

SEQ ID NO: 1380638 - protein, 9 aa, Homo Sapiens
KASVVVAVR

SEQ ID NO: 1380639 - protein, 9 aa, Homo Sapiens
EDLAYSGFE

SEQ ID NO: 1380640 - protein, 9 aa, Homo Sapiens
TISRNNIRK

SEQ ID NO: 1380641 - protein, 9 aa, Homo Sapiens
SVASVYHEK

SEQ ID NO: 1380642 - protein, 9 aa, Homo Sapiens
WDVLFQVSP

SEQ ID NO: 1380643 - protein, 9 aa, Homo Sapiens
TLTVPIVPF

SEQ ID NO: 1380644 - protein, 9 aa, Homo Sapiens
ALFETCSHI

SEQ ID NO: 1380645 - protein, 9 aa, Homo Sapiens
ISLSETRNQ

SEQ ID NO: 1380646 - protein, 9 aa, Homo Sapiens
KKKKEAYSA

SEQ ID NO: 1380647 - protein, 9 aa, Homo Sapiens
SLQLTPPKW

SEQ ID NO: 1380648 - protein, 9 aa, Homo Sapiens
DSRCAPGTQ

SEQ ID NO: 1380649 - protein, 9 aa, Homo Sapiens
LIEKNLIWQ

SEQ ID NO: 1380650 - protein, 9 aa, Homo Sapiens
MHAHYNAHA

SEQ ID NO: 1380651 - protein, 9 aa, Homo Sapiens
DHAISLSGP

SEQ ID NO: 1380652 - protein, 9 aa, Homo Sapiens
IRMQLHMST

SEQ ID NO: 1380653 - protein, 9 aa, Homo Sapiens
QRNAAPRPA

SEQ ID NO: 1380654 - protein, 9 aa, Homo Sapiens
LDGYDIWEA

SEQ ID NO: 1380655 - protein, 9 aa, Homo Sapiens
WPSRPRHPR

SEQ ID NO: 1380656 - protein, 9 aa, Homo Sapiens
DLLSIRCPA

SEQ ID NO: 1380657 - protein, 9 aa, Homo Sapiens
DQGPNKGFD

SEQ ID NO: 1380658 - protein, 9 aa, Homo Sapiens
CCCCCGERE

SEQ ID NO: 1380659 - protein, 9 aa, Homo Sapiens
QRVRKNHSS

SEQ ID NO: 1380660 - protein, 9 aa, Homo Sapiens
KSVWGSLTV

SEQ ID NO: 1380661 - protein, 9 aa, Homo Sapiens
QLLGCSHVC

SEQ ID NO: 1380662 - protein, 9 aa, Homo Sapiens
GCPRSQSQI

SEQ ID NO: 1380663 - protein, 9 aa, Homo Sapiens
PANYSPGGL

SEQ ID NO: 1380664 - protein, 9 aa, Homo Sapiens
ATAAGISQL

SEQ ID NO: 1380665 - protein, 9 aa, Homo Sapiens
KGSLQLTPP

SEQ ID NO: 1380666 - protein, 9 aa, Homo Sapiens
TNIPQRSAP

SEQ ID NO: 1380667 - protein, 9 aa, Homo Sapiens
RKWKKGLGK

SEQ ID NO: 1380668 - protein, 9 aa, Homo Sapiens
CCRPSCCST

SEQ ID NO: 1380669 - protein, 9 aa, Homo Sapiens
RPFLELKIR

SEQ ID NO: 1380670 - protein, 9 aa, Homo Sapiens
VSGHFAQDC

SEQ ID NO: 1380671 - protein, 9 aa, Homo Sapiens
AVPLTASGN

SEQ ID NO: 1380672 - protein, 9 aa, Homo Sapiens
QLYCLFSQQ

SEQ ID NO: 1380673 - protein, 9 aa, Homo Sapiens
FLASKDEGL

SEQ ID NO: 1380674 - protein, 9 aa, Homo Sapiens
KEGQEVGLL

SEQ ID NO: 1380675 - protein, 9 aa, Homo Sapiens
AQLPASPLL

SEQ ID NO: 1380676 - protein, 9 aa, Homo Sapiens
CDYGSGRLF

SEQ ID NO: 1380677 - protein, 9 aa, Homo Sapiens
EEEEEGFDW

SEQ ID NO: 1380678 - protein, 9 aa, Homo Sapiens
FFVVVSLHK

SEQ ID NO: 1380679 - protein, 9 aa, Homo Sapiens
VTCQIMVMM

SEQ ID NO: 1380680 - protein, 9 aa, Homo Sapiens
WTGASPNLS

SEQ ID NO: 1380681 - protein, 9 aa, Homo Sapiens
HLLCHGQVQ

SEQ ID NO: 1380682 - protein, 9 aa, Homo Sapiens
VAYAATRDN

SEQ ID NO: 1380683 - protein, 9 aa, Homo Sapiens
HYQAAWRKM

SEQ ID NO: 1380684 - protein, 9 aa, Homo Sapiens
RLRVLYQIE

SEQ ID NO: 1380685 - protein, 9 aa, Homo Sapiens
DFLATSSPT

SEQ ID NO: 1380686 - protein, 9 aa, Homo Sapiens
QAAHPTDPG

SEQ ID NO: 1380687 - protein, 9 aa, Homo Sapiens
SQDHHNNSL

SEQ ID NO: 1380688 - protein, 9 aa, Homo Sapiens
KREPEREKP

SEQ ID NO: 1380689 - protein, 9 aa, Homo Sapiens
SVEKTRAYK

SEQ ID NO: 1380690 - protein, 9 aa, Homo Sapiens
RRAAQQWPC

SEQ ID NO: 1380691 - protein, 9 aa, Homo Sapiens
AEFGDLEVA

SEQ ID NO: 1380692 - protein, 9 aa, Homo Sapiens
KVQSHAVKI

SEQ ID NO: 1380693 - protein, 9 aa, Homo Sapiens
LSLHRWTGT

SEQ ID NO: 1380694 - protein, 9 aa, Homo Sapiens
RLTSLGVIE

SEQ ID NO: 1380695 - protein, 9 aa, Homo Sapiens
MEIVWNAVE

SEQ ID NO: 1380696 - protein, 9 aa, Homo Sapiens
KKGLGKGNK

SEQ ID NO: 1380697 - protein, 9 aa, Homo Sapiens
LFNTVTPCQ

SEQ ID NO: 1380698 - protein, 9 aa, Homo Sapiens
DYIFHCRPP

SEQ ID NO: 1380699 - protein, 9 aa, Homo Sapiens
NIFDSIIII

SEQ ID NO: 1380700 - protein, 9 aa, Homo Sapiens
LEYDAREQR

SEQ ID NO: 1380701 - protein, 9 aa, Homo Sapiens
HKLALEPGS

SEQ ID NO: 1380702 - protein, 9 aa, Homo Sapiens
QRPFLELKI

SEQ ID NO: 1380703 - protein, 9 aa, Homo Sapiens
QGRSRAKVV

SEQ ID NO: 1380704 - protein, 9 aa, Homo Sapiens
AISLTTPGP

SEQ ID NO: 1380705 - protein, 9 aa, Homo Sapiens
FLSGSNFGI

SEQ ID NO: 1380706 - protein, 9 aa, Homo Sapiens
HQPLLPVSQ

SEQ ID NO: 1380707 - protein, 9 aa, Homo Sapiens
GGVGDGDED

SEQ ID NO: 1380708 - protein, 9 aa, Homo Sapiens
RLEKLWNGE

SEQ ID NO: 1380709 - protein, 9 aa, Homo Sapiens
VLQHGDEAA

SEQ ID NO: 1380710 - protein, 9 aa, Homo Sapiens
RALFETCSH

SEQ ID NO: 1380711 - protein, 9 aa, Homo Sapiens
IASFSHHSV

SEQ ID NO: 1380712 - protein, 9 aa, Homo Sapiens
IWSPTLTKH

SEQ ID NO: 1380713 - protein, 9 aa, Homo Sapiens
IRTVLPHIW

SEQ ID NO: 1380714 - protein, 9 aa, Homo Sapiens
AVGRQLGPQ

SEQ ID NO: 1380715 - protein, 9 aa, Homo Sapiens
WNIFDSIII

SEQ ID NO: 1380716 - protein, 9 aa, Homo Sapiens
TTVKFTPTS

SEQ ID NO: 1380717 - protein, 9 aa, Homo Sapiens
PHIWKVPDV

SEQ ID NO: 1380718 - protein, 9 aa, Homo Sapiens
VNMMCQHTM

SEQ ID NO: 1380719 - protein, 9 aa, Homo Sapiens
SPPPSQTAR

SEQ ID NO: 1380720 - protein, 9 aa, Homo Sapiens
GKNHHHSEY

SEQ ID NO: 1380721 - protein, 9 aa, Homo Sapiens
IMVSAGDTL

SEQ ID NO: 1380722 - protein, 9 aa, Homo Sapiens
ESHVVRLCR

SEQ ID NO: 1380723 - protein, 9 aa, Homo Sapiens
LVQYIIMVN

SEQ ID NO: 1380724 - protein, 9 aa, Homo Sapiens
QAQCLLRHA

SEQ ID NO: 1380725 - protein, 9 aa, Homo Sapiens
FNTVTPCQQ

SEQ ID NO: 1380726 - protein, 9 aa, Homo Sapiens
KPVGKEALC

SEQ ID NO: 1380727 - protein, 9 aa, Homo Sapiens
GRKACSTRT

SEQ ID NO: 1380728 - protein, 9 aa, Homo Sapiens
EDRPLPVDA

SEQ ID NO: 1380729 - protein, 9 aa, Homo Sapiens
TFDMGGHVQ

SEQ ID NO: 1380730 - protein, 9 aa, Homo Sapiens
GYRERGGGC

SEQ ID NO: 1380731 - protein, 9 aa, Homo Sapiens
LCSNLSVKN

SEQ ID NO: 1380732 - protein, 9 aa, Homo Sapiens
LRDPNTPVI

SEQ ID NO: 1380733 - protein, 9 aa, Homo Sapiens
KEELSRNSR

SEQ ID NO: 1380734 - protein, 9 aa, Homo Sapiens
SVKNVADTL

SEQ ID NO: 1380735 - protein, 9 aa, Homo Sapiens
YNPFAWMFF

SEQ ID NO: 1380736 - protein, 9 aa, Homo Sapiens
VKEMDEEGN

SEQ ID NO: 1380737 - protein, 9 aa, Homo Sapiens
HFWIQDKGP

SEQ ID NO: 1380738 - protein, 9 aa, Homo Sapiens
VPTKSSRKA

SEQ ID NO: 1380739 - protein, 9 aa, Homo Sapiens
GNERLPSLG

SEQ ID NO: 1380740 - protein, 9 aa, Homo Sapiens
KCPGGRRRG

SEQ ID NO: 1380741 - protein, 9 aa, Homo Sapiens
ILWFKVVTS

SEQ ID NO: 1380742 - protein, 9 aa, Homo Sapiens
NLSVKNVAD

SEQ ID NO: 1380743 - protein, 9 aa, Homo Sapiens
KTDLGRRGW

SEQ ID NO: 1380744 - protein, 9 aa, Homo Sapiens
SVWGSLTVQ

SEQ ID NO: 1380745 - protein, 9 aa, Homo Sapiens
LPAEPCPRL

SEQ ID NO: 1380746 - protein, 9 aa, Homo Sapiens
RSTQTVFSM

SEQ ID NO: 1380747 - protein, 9 aa, Homo Sapiens
RPANYSPGG

SEQ ID NO: 1380748 - protein, 9 aa, Homo Sapiens
SSLRCHRHK

SEQ ID NO: 1380749 - protein, 9 aa, Homo Sapiens
KKIFALLEL

SEQ ID NO: 1380750 - protein, 9 aa, Homo Sapiens
CGNCTYQEG

SEQ ID NO: 1380751 - protein, 9 aa, Homo Sapiens
TPIEGWSHF

SEQ ID NO: 1380752 - protein, 9 aa, Homo Sapiens
RKKLRKRLY

SEQ ID NO: 1380753 - protein, 9 aa, Homo Sapiens
CSSALNTHK

SEQ ID NO: 1380754 - protein, 9 aa, Homo Sapiens
HSAVHGGVC

SEQ ID NO: 1380755 - protein, 9 aa, Homo Sapiens
KSEVQVTYM

SEQ ID NO: 1380756 - protein, 9 aa, Homo Sapiens
PENSLPPKK

SEQ ID NO: 1380757 - protein, 9 aa, Homo Sapiens
RPISRGAFG

SEQ ID NO: 1380758 - protein, 9 aa, Homo Sapiens
HVVRLLGAV

SEQ ID NO: 1380759 - protein, 9 aa, Homo Sapiens
ELERGDLGY

SEQ ID NO: 1380760 - protein, 9 aa, Homo Sapiens
GSFVAMPRN

SEQ ID NO: 1380761 - protein, 9 aa, Homo Sapiens
IVWNAVEML

SEQ ID NO: 1380762 - protein, 9 aa, Homo Sapiens
EKTRAYKVC

SEQ ID NO: 1380763 - protein, 9 aa, Homo Sapiens
YIPAQQDVL

SEQ ID NO: 1380764 - protein, 9 aa, Homo Sapiens
EPWKAKRQE

SEQ ID NO: 1380765 - protein, 9 aa, Homo Sapiens
HSWSGVAFN

SEQ ID NO: 1380766 - protein, 9 aa, Homo Sapiens
ERIVELLGL

SEQ ID NO: 1380767 - protein, 9 aa, Homo Sapiens
SREVVGEGL

SEQ ID NO: 1380768 - protein, 9 aa, Homo Sapiens
GHLVRIKPT

SEQ ID NO: 1380769 - protein, 9 aa, Homo Sapiens
PGLAVPARL

SEQ ID NO: 1380770 - protein, 9 aa, Homo Sapiens
VTGLPGSVP

SEQ ID NO: 1380771 - protein, 9 aa, Homo Sapiens
IPEGPAVQH

SEQ ID NO: 1380772 - protein, 9 aa, Homo Sapiens
NAHAPPHTM

SEQ ID NO: 1380773 - protein, 9 aa, Homo Sapiens
KLLYGKRSQ

SEQ ID NO: 1380774 - protein, 9 aa, Homo Sapiens
PGSPYKFLT

SEQ ID NO: 1380775 - protein, 9 aa, Homo Sapiens
VNVVGTVRV

SEQ ID NO: 1380776 - protein, 9 aa, Homo Sapiens
IDMTGFLCA

SEQ ID NO: 1380777 - protein, 9 aa, Homo Sapiens
SPTRRRRQR

SEQ ID NO: 1380778 - protein, 9 aa, Homo Sapiens
RLGDEIGRK

SEQ ID NO: 1380779 - protein, 9 aa, Homo Sapiens
RQEVRGSHR

SEQ ID NO: 1380780 - protein, 9 aa, Homo Sapiens
QRLIQEKGS

SEQ ID NO: 1380781 - protein, 9 aa, Homo Sapiens
KRQAVNMMC

SEQ ID NO: 1380782 - protein, 9 aa, Homo Sapiens
FSDSSQSDP

SEQ ID NO: 1380783 - protein, 9 aa, Homo Sapiens
PLTASGNSF

SEQ ID NO: 1380784 - protein, 9 aa, Homo Sapiens
FKVSSAKFP

SEQ ID NO: 1380785 - protein, 9 aa, Homo Sapiens
PADQRRPRH

SEQ ID NO: 1380786 - protein, 9 aa, Homo Sapiens
SSLQGIQFS

SEQ ID NO: 1380787 - protein, 9 aa, Homo Sapiens
SLKDEEQER

SEQ ID NO: 1380788 - protein, 9 aa, Homo Sapiens
TLLNTPPEG

SEQ ID NO: 1380789 - protein, 9 aa, Homo Sapiens
PVGNREKIL

SEQ ID NO: 1380790 - protein, 9 aa, Homo Sapiens
VAAVTFEWT

SEQ ID NO: 1380791 - protein, 9 aa, Homo Sapiens
WPITPTPQV

SEQ ID NO: 1380792 - protein, 9 aa, Homo Sapiens
CCRCCCCCG

SEQ ID NO: 1380793 - protein, 9 aa, Homo Sapiens
FIWSPTLTK

SEQ ID NO: 1380794 - protein, 9 aa, Homo Sapiens
QPAVCPRHP

SEQ ID NO: 1380795 - protein, 9 aa, Homo Sapiens
AFRKGGVVT

SEQ ID NO: 1380796 - protein, 9 aa, Homo Sapiens
VFAQFIIDG

SEQ ID NO: 1380797 - protein, 9 aa, Homo Sapiens
INHIFHERF

SEQ ID NO: 1380798 - protein, 9 aa, Homo Sapiens
VLPHIWKVP

SEQ ID NO: 1380799 - protein, 9 aa, Homo Sapiens
AWPITPTPQ

SEQ ID NO: 1380800 - protein, 9 aa, Homo Sapiens
EGWSHFDSL

SEQ ID NO: 1380801 - protein, 9 aa, Homo Sapiens
EIEMSATLP

SEQ ID NO: 1380802 - protein, 9 aa, Homo Sapiens
VHGGVCHRT

SEQ ID NO: 1380803 - protein, 9 aa, Homo Sapiens
GKKYYQKCD

SEQ ID NO: 1380804 - protein, 9 aa, Homo Sapiens
QGQAAHPTD

SEQ ID NO: 1380805 - protein, 9 aa, Homo Sapiens
CPCRDPRSS

SEQ ID NO: 1380806 - protein, 9 aa, Homo Sapiens
DHSPRSWTR

SEQ ID NO: 1380807 - protein, 9 aa, Homo Sapiens
GNREKILNR

SEQ ID NO: 1380808 - protein, 9 aa, Homo Sapiens
VMVGTEEEI

SEQ ID NO: 1380809 - protein, 9 aa, Homo Sapiens
QEMELRRLG

SEQ ID NO: 1380810 - protein, 9 aa, Homo Sapiens
KADPHTCPI

SEQ ID NO: 1380811 - protein, 9 aa, Homo Sapiens
WEAISEGLR

SEQ ID NO: 1380812 - protein, 9 aa, Homo Sapiens
KTPPKCPGG

SEQ ID NO: 1380813 - protein, 9 aa, Homo Sapiens
FITSSYHSK

SEQ ID NO: 1380814 - protein, 9 aa, Homo Sapiens
RAPEASWSP

SEQ ID NO: 1380815 - protein, 9 aa, Homo Sapiens
VEVTVAGFQ

SEQ ID NO: 1380816 - protein, 9 aa, Homo Sapiens
AGWRPLGDS

SEQ ID NO: 1380817 - protein, 9 aa, Homo Sapiens
TGWAASPAA

SEQ ID NO: 1380818 - protein, 9 aa, Homo Sapiens
PQRSAPGTL

SEQ ID NO: 1380819 - protein, 9 aa, Homo Sapiens
SPPSRSAAD

SEQ ID NO: 1380820 - protein, 9 aa, Homo Sapiens
LPPEPGDPD

SEQ ID NO: 1380821 - protein, 9 aa, Homo Sapiens
SVSTIIRLL

SEQ ID NO: 1380822 - protein, 9 aa, Homo Sapiens
GWGGDCPKG

SEQ ID NO: 1380823 - protein, 9 aa, Homo Sapiens
GEARAPLES

SEQ ID NO: 1380824 - protein, 9 aa, Homo Sapiens
ASEAGDVPF

SEQ ID NO: 1380825 - protein, 9 aa, Homo Sapiens
AGRPWEPSA

SEQ ID NO: 1380826 - protein, 9 aa, Homo Sapiens
NRTVLENPR

SEQ ID NO: 1380827 - protein, 9 aa, Homo Sapiens
APPHTMQPD

SEQ ID NO: 1380828 - protein, 9 aa, Homo Sapiens
DEQSNHTTN

SEQ ID NO: 1380829 - protein, 9 aa, Homo Sapiens
PPRHPSIHP

SEQ ID NO: 1380830 - protein, 9 aa, Homo Sapiens
ISCLGAFGQ

SEQ ID NO: 1380831 - protein, 9 aa, Homo Sapiens
EQRKEPWKA

SEQ ID NO: 1380832 - protein, 9 aa, Homo Sapiens
MARRLAYLH

SEQ ID NO: 1380833 - protein, 9 aa, Homo Sapiens
VERRQFNRE

SEQ ID NO: 1380834 - protein, 9 aa, Homo Sapiens
KVQRPRCFL

SEQ ID NO: 1380835 - protein, 9 aa, Homo Sapiens
PEQFRHVIW

SEQ ID NO: 1380836 - protein, 9 aa, Homo Sapiens
DSITSNVLP

SEQ ID NO: 1380837 - protein, 9 aa, Homo Sapiens
QHCLECWST

SEQ ID NO: 1380838 - protein, 9 aa, Homo Sapiens
EGQEVGLLP

SEQ ID NO: 1380839 - protein, 9 aa, Homo Sapiens
EVQVTYMGS

SEQ ID NO: 1380840 - protein, 9 aa, Homo Sapiens
LPAQLPASP

SEQ ID NO: 1380841 - protein, 9 aa, Homo Sapiens
LPAPSRALP

SEQ ID NO: 1380842 - protein, 9 aa, Homo Sapiens
KDCGNCTYQ

SEQ ID NO: 1380843 - protein, 9 aa, Homo Sapiens
SKKKDSQNC

SEQ ID NO: 1380844 - protein, 9 aa, Homo Sapiens
KPFLAALVD

SEQ ID NO: 1380845 - protein, 9 aa, Homo Sapiens
AKSLAMTVT

SEQ ID NO: 1380846 - protein, 9 aa, Homo Sapiens
SSSHMGAPP

SEQ ID NO: 1380847 - protein, 9 aa, Homo Sapiens
TPSTAGLGY

SEQ ID NO: 1380848 - protein, 9 aa, Homo Sapiens
KDFLATSSP

SEQ ID NO: 1380849 - protein, 9 aa, Homo Sapiens
GGGFGGGEY

SEQ ID NO: 1380850 - protein, 9 aa, Homo Sapiens
GVHEGCAEE

SEQ ID NO: 1380851 - protein, 9 aa, Homo Sapiens
VFVPQRPQT

SEQ ID NO: 1380852 - protein, 9 aa, Homo Sapiens
SVVSNRQVD

SEQ ID NO: 1380853 - protein, 9 aa, Homo Sapiens
VRRAAQQWP

SEQ ID NO: 1380854 - protein, 9 aa, Homo Sapiens
NYVISSFYP

SEQ ID NO: 1380855 - protein, 9 aa, Homo Sapiens
RSIARARNR

SEQ ID NO: 1380856 - protein, 9 aa, Homo Sapiens
IRWGADAYQ

SEQ ID NO: 1380857 - protein, 9 aa, Homo Sapiens
IRPSVYSNV

SEQ ID NO: 1380858 - protein, 9 aa, Homo Sapiens
ALASKRFCA

SEQ ID NO: 1380859 - protein, 9 aa, Homo Sapiens
KAKRQEAVA

SEQ ID NO: 1380860 - protein, 9 aa, Homo Sapiens
ELRKKLRKR

SEQ ID NO: 1380861 - protein, 9 aa, Homo Sapiens
PAPSTPATP

SEQ ID NO: 1380862 - protein, 9 aa, Homo Sapiens
VCHRTKVCA

SEQ ID NO: 1380863 - protein, 9 aa, Homo Sapiens
VKAKVQDKE

SEQ ID NO: 1380864 - protein, 9 aa, Homo Sapiens
AHASGPGPH

SEQ ID NO: 1380865 - protein, 9 aa, Homo Sapiens
GSGYWLVQQ

SEQ ID NO: 1380866 - protein, 9 aa, Homo Sapiens
PVSQEFILC

SEQ ID NO: 1380867 - protein, 9 aa, Homo Sapiens
KGCLKVNPD

SEQ ID NO: 1380868 - protein, 9 aa, Homo Sapiens
SGGRTAAVG

SEQ ID NO: 1380869 - protein, 9 aa, Homo Sapiens
VLEYDAREQ

SEQ ID NO: 1380870 - protein, 9 aa, Homo Sapiens
DPQLHRIIG

SEQ ID NO: 1380871 - protein, 9 aa, Homo Sapiens
EVEEFYKKK

SEQ ID NO: 1380872 - protein, 9 aa, Homo Sapiens
PEPGRVGGS

SEQ ID NO: 1380873 - protein, 9 aa, Homo Sapiens
RENVCLNYC

SEQ ID NO: 1380874 - protein, 9 aa, Homo Sapiens
PFIPRRAKT

SEQ ID NO: 1380875 - protein, 9 aa, Homo Sapiens
KQRDPRLNK

SEQ ID NO: 1380876 - protein, 9 aa, Homo Sapiens
GRLKDIALV

SEQ ID NO: 1380877 - protein, 9 aa, Homo Sapiens
HKEYSKCLC

SEQ ID NO: 1380878 - protein, 9 aa, Homo Sapiens
IGGGVARVE

SEQ ID NO: 1380879 - protein, 9 aa, Homo Sapiens
GKPVGKEAL

SEQ ID NO: 1380880 - protein, 9 aa, Homo Sapiens
QNCEDAQAI

SEQ ID NO: 1380881 - protein, 9 aa, Homo Sapiens
VRPVATLSP

SEQ ID NO: 1380882 - protein, 9 aa, Homo Sapiens
TTNRAGLLA

SEQ ID NO: 1380883 - protein, 9 aa, Homo Sapiens
VYSNVARQL

SEQ ID NO: 1380884 - protein, 9 aa, Homo Sapiens
LCHSYCCIR

SEQ ID NO: 1380885 - protein, 9 aa, Homo Sapiens
KGGFFCEKY

SEQ ID NO: 1380886 - protein, 9 aa, Homo Sapiens
GREEIYFLS

SEQ ID NO: 1380887 - protein, 9 aa, Homo Sapiens
TGASPNLSE

SEQ ID NO: 1380888 - protein, 9 aa, Homo Sapiens
QIEKMFLQL

SEQ ID NO: 1380889 - protein, 9 aa, Homo Sapiens
GVTTVNSPG

SEQ ID NO: 1380890 - protein, 9 aa, Homo Sapiens
ASGSGLGPQ

SEQ ID NO: 1380891 - protein, 9 aa, Homo Sapiens
GPAVQHCNL

SEQ ID NO: 1380892 - protein, 9 aa, Homo Sapiens
WTSLVQRDR

SEQ ID NO: 1380893 - protein, 9 aa, Homo Sapiens
CPENSLPPK

SEQ ID NO: 1380894 - protein, 9 aa, Homo Sapiens
PSNPPRHPS

SEQ ID NO: 1380895 - protein, 9 aa, Homo Sapiens
IWEAISEGL

SEQ ID NO: 1380896 - protein, 9 aa, Homo Sapiens
PVDIVTGGV

SEQ ID NO: 1380897 - protein, 9 aa, Homo Sapiens
SFVAMPRNG

SEQ ID NO: 1380898 - protein, 9 aa, Homo Sapiens
RDEKGEIEQ

SEQ ID NO: 1380899 - protein, 9 aa, Homo Sapiens
PVPSYKWLR

SEQ ID NO: 1380900 - protein, 9 aa, Homo Sapiens
GRGPAALHP

SEQ ID NO: 1380901 - protein, 9 aa, Homo Sapiens
KGRVSMCAA

SEQ ID NO: 1380902 - protein, 9 aa, Homo Sapiens
FIFLLVAYM

SEQ ID NO: 1380903 - protein, 9 aa, Homo Sapiens
PFAWMFFLV

SEQ ID NO: 1380904 - protein, 9 aa, Homo Sapiens
PRAALAPAL

SEQ ID NO: 1380905 - protein, 9 aa, Homo Sapiens
RNVWSLPAE

SEQ ID NO: 1380906 - protein, 9 aa, Homo Sapiens
GPRMLWGSD

SEQ ID NO: 1380907 - protein, 9 aa, Homo Sapiens
DDDFLEKKW

SEQ ID NO: 1380908 - protein, 9 aa, Homo Sapiens
KDEEQERRD

SEQ ID NO: 1380909 - protein, 9 aa, Homo Sapiens
EVFQLLTDP

SEQ ID NO: 1380910 - protein, 9 aa, Homo Sapiens
MSDHLSINP

SEQ ID NO: 1380911 - protein, 9 aa, Homo Sapiens
IIENVDVCL

SEQ ID NO: 1380912 - protein, 9 aa, Homo Sapiens
VCTLHPSGE

SEQ ID NO: 1380913 - protein, 9 aa, Homo Sapiens
RKNVFKEAS

SEQ ID NO: 1380914 - protein, 9 aa, Homo Sapiens
MNDTHVDED

SEQ ID NO: 1380915 - protein, 9 aa, Homo Sapiens
EGKKNLCCF

SEQ ID NO: 1380916 - protein, 9 aa, Homo Sapiens
NDDNCQAFI

SEQ ID NO: 1380917 - protein, 9 aa, Homo Sapiens
LLDTAGHQR

SEQ ID NO: 1380918 - protein, 9 aa, Homo Sapiens
ERRDPGHRQ

SEQ ID NO: 1380919 - protein, 9 aa, Homo Sapiens
LKAENLLLG

SEQ ID NO: 1380920 - protein, 9 aa, Homo Sapiens
PFRLCHVTT

SEQ ID NO: 1380921 - protein, 9 aa, Homo Sapiens
KEHEIRMQL

SEQ ID NO: 1380922 - protein, 9 aa, Homo Sapiens
PTSPRGKPV

SEQ ID NO: 1380923 - protein, 9 aa, Homo Sapiens
PTPQVPRLP

SEQ ID NO: 1380924 - protein, 9 aa, Homo Sapiens
DEKTVQCYW

SEQ ID NO: 1380925 - protein, 9 aa, Homo Sapiens
SLLCRYYPV

SEQ ID NO: 1380926 - protein, 9 aa, Homo Sapiens
WQLWHRELQ

SEQ ID NO: 1380927 - protein, 9 aa, Homo Sapiens
PAGTRTEGQ

SEQ ID NO: 1380928 - protein, 9 aa, Homo Sapiens
LCQRSTQTV

SEQ ID NO: 1380929 - protein, 9 aa, Homo Sapiens
PEVPDSLAL

SEQ ID NO: 1380930 - protein, 9 aa, Homo Sapiens
TAGHQRPFL

SEQ ID NO: 1380931 - protein, 9 aa, Homo Sapiens
LARSSRASL

SEQ ID NO: 1380932 - protein, 9 aa, Homo Sapiens
IHLIVHQRT

SEQ ID NO: 1380933 - protein, 9 aa, Homo Sapiens
DIHLWQPDA

SEQ ID NO: 1380934 - protein, 9 aa, Homo Sapiens
PAALHPGLA

SEQ ID NO: 1380935 - protein, 9 aa, Homo Sapiens
RTVLPHIWK

SEQ ID NO: 1380936 - protein, 9 aa, Homo Sapiens
MGTPRLEKL

SEQ ID NO: 1380937 - protein, 9 aa, Homo Sapiens
YEVKPFLAA

SEQ ID NO: 1380938 - protein, 9 aa, Homo Sapiens
IASDLCQRS

SEQ ID NO: 1380939 - protein, 9 aa, Homo Sapiens
VGAVPLTAS

SEQ ID NO: 1380940 - protein, 9 aa, Homo Sapiens
TDSLQEWID

SEQ ID NO: 1380941 - protein, 9 aa, Homo Sapiens
KKKNKEEER

SEQ ID NO: 1380942 - protein, 9 aa, Homo Sapiens
GGVSPVRDL

SEQ ID NO: 1380943 - protein, 9 aa, Homo Sapiens
KNRQKSLKD

SEQ ID NO: 1380944 - protein, 9 aa, Homo Sapiens
GCKWMDSLL

SEQ ID NO: 1380945 - protein, 9 aa, Homo Sapiens
DGGVGDGDE

SEQ ID NO: 1380946 - protein, 9 aa, Homo Sapiens
AQCLLRHAW

SEQ ID NO: 1380947 - protein, 9 aa, Homo Sapiens
TGGVSPVRD

SEQ ID NO: 1380948 - protein, 9 aa, Homo Sapiens
DKGGFFCEK

SEQ ID NO: 1380949 - protein, 9 aa, Homo Sapiens
ARVEVAAGP

SEQ ID NO: 1380950 - protein, 9 aa, Homo Sapiens
EVAAGPPMR

SEQ ID NO: 1380951 - protein, 9 aa, Homo Sapiens
HTETDAVDP

SEQ ID NO: 1380952 - protein, 9 aa, Homo Sapiens
ERLPSLGLP

SEQ ID NO: 1380953 - protein, 9 aa, Homo Sapiens
DSTQGKNHH

SEQ ID NO: 1380954 - protein, 9 aa, Homo Sapiens
GQEETVHIV

SEQ ID NO: 1380955 - protein, 9 aa, Homo Sapiens
DEKELDQRE

SEQ ID NO: 1380956 - protein, 9 aa, Homo Sapiens
VSSAKFPKD

SEQ ID NO: 1380957 - protein, 9 aa, Homo Sapiens
FIITNCCLF

SEQ ID NO: 1380958 - protein, 9 aa, Homo Sapiens
PAKVQGQAA

SEQ ID NO: 1380959 - protein, 9 aa, Homo Sapiens
DLLFSDSSQ

SEQ ID NO: 1380960 - protein, 9 aa, Homo Sapiens
LRCGTWTCS

SEQ ID NO: 1380961 - protein, 9 aa, Homo Sapiens
FRTWVERRQ

SEQ ID NO: 1380962 - protein, 9 aa, Homo Sapiens
TPITPASGL

SEQ ID NO: 1380963 - protein, 9 aa, Homo Sapiens
PSQPKKCPC

SEQ ID NO: 1380964 - protein, 9 aa, Homo Sapiens
ALYHGTIDS

SEQ ID NO: 1380965 - protein, 9 aa, Homo Sapiens
TEGQASPPA

SEQ ID NO: 1380966 - protein, 9 aa, Homo Sapiens
GGSLGSFVA

SEQ ID NO: 1380967 - protein, 9 aa, Homo Sapiens
KVVTSVKEM

SEQ ID NO: 1380968 - protein, 9 aa, Homo Sapiens
FLMCAPKHA

SEQ ID NO: 1380969 - protein, 9 aa, Homo Sapiens
AGMYTCAGT

SEQ ID NO: 1380970 - protein, 9 aa, Homo Sapiens
ATVPLQHHV

SEQ ID NO: 1380971 - protein, 9 aa, Homo Sapiens
PYGLVAPPF

SEQ ID NO: 1380972 - protein, 9 aa, Homo Sapiens
SGGRCALLA

SEQ ID NO: 1380973 - protein, 9 aa, Homo Sapiens
IAQSDYIPA

SEQ ID NO: 1380974 - protein, 9 aa, Homo Sapiens
WPEPGRVGG

SEQ ID NO: 1380975 - protein, 9 aa, Homo Sapiens
ITEIKDGEF

SEQ ID NO: 1380976 - protein, 9 aa, Homo Sapiens
RDKRKCFEI

SEQ ID NO: 1380977 - protein, 9 aa, Homo Sapiens
CHGGRHLPL

SEQ ID NO: 1380978 - protein, 9 aa, Homo Sapiens
KDVNIQVRK

SEQ ID NO: 1380979 - protein, 9 aa, Homo Sapiens
PALLVPHAC

SEQ ID NO: 1380980 - protein, 9 aa, Homo Sapiens
SAQIHQERR

SEQ ID NO: 1380981 - protein, 9 aa, Homo Sapiens
LSFSEPSSC

SEQ ID NO: 1380982 - protein, 9 aa, Homo Sapiens
LIQEKGSVS

SEQ ID NO: 1380983 - protein, 9 aa, Homo Sapiens
TSWGLETNI

SEQ ID NO: 1380984 - protein, 9 aa, Homo Sapiens
KFTPTSVIT

SEQ ID NO: 1380985 - protein, 9 aa, Homo Sapiens
CALMLLAAW

SEQ ID NO: 1380986 - protein, 9 aa, Homo Sapiens
QDYGSAQGA

SEQ ID NO: 1380987 - protein, 9 aa, Homo Sapiens
GTPAYVAPE

SEQ ID NO: 1380988 - protein, 9 aa, Homo Sapiens
SKKQKKREK

SEQ ID NO: 1380989 - protein, 9 aa, Homo Sapiens
IPRRAKTAV

SEQ ID NO: 1380990 - protein, 9 aa, Homo Sapiens
AASAWAPRS

SEQ ID NO: 1380991 - protein, 9 aa, Homo Sapiens
SFPLGVEFV

SEQ ID NO: 1380992 - protein, 9 aa, Homo Sapiens
AAVVMVVRP

SEQ ID NO: 1380993 - protein, 9 aa, Homo Sapiens
EMSATLPIN

SEQ ID NO: 1380994 - protein, 9 aa, Homo Sapiens
GRTAAVGKA

SEQ ID NO: 1380995 - protein, 9 aa, Homo Sapiens
VDEDLKAIK

SEQ ID NO: 1380996 - protein, 9 aa, Homo Sapiens
LLVWHYCTL

SEQ ID NO: 1380997 - protein, 9 aa, Homo Sapiens
AGAASAWAP

SEQ ID NO: 1380998 - protein, 9 aa, Homo Sapiens
HIHPELRKK

SEQ ID NO: 1380999 - protein, 9 aa, Homo Sapiens
DQRRPRHGH

SEQ ID NO: 1381000 - protein, 9 aa, Homo Sapiens
NCSIRRKSK

SEQ ID NO: 1381001 - protein, 9 aa, Homo Sapiens
VLFVCTLHP

SEQ ID NO: 1381002 - protein, 9 aa, Homo Sapiens
ISLPLDRPQ

SEQ ID NO: 1381003 - protein, 9 aa, Homo Sapiens
TIAVSSAHR

SEQ ID NO: 1381004 - protein, 9 aa, Homo Sapiens
ELSAHQAPS

SEQ ID NO: 1381005 - protein, 9 aa, Homo Sapiens
QSPVQRQRE

SEQ ID NO: 1381006 - protein, 9 aa, Homo Sapiens
EKPYKWTWE

SEQ ID NO: 1381007 - protein, 9 aa, Homo Sapiens
CRPPDQKIP

SEQ ID NO: 1381008 - protein, 9 aa, Homo Sapiens
SIVRPISRG

SEQ ID NO: 1381009 - protein, 9 aa, Homo Sapiens
LAENAAVDA

SEQ ID NO: 1381010 - protein, 9 aa, Homo Sapiens
VIVVSEPSE

SEQ ID NO: 1381011 - protein, 9 aa, Homo Sapiens
PARGGKWRS

SEQ ID NO: 1381012 - protein, 9 aa, Homo Sapiens
IEALTKKKE

SEQ ID NO: 1381013 - protein, 9 aa, Homo Sapiens
SAATAAGIS

SEQ ID NO: 1381014 - protein, 9 aa, Homo Sapiens
TEGKKNLCC

SEQ ID NO: 1381015 - protein, 9 aa, Homo Sapiens
NFMKGCLKV

SEQ ID NO: 1381016 - protein, 9 aa, Homo Sapiens
EIKDGEFKN

SEQ ID NO: 1381017 - protein, 9 aa, Homo Sapiens
GGVARVEVA

SEQ ID NO: 1381018 - protein, 9 aa, Homo Sapiens
GQVQGQQER

SEQ ID NO: 1381019 - protein, 9 aa, Homo Sapiens
VYHEKILIG

SEQ ID NO: 1381020 - protein, 9 aa, Homo Sapiens
SQQNKNTPS

SEQ ID NO: 1381021 - protein, 9 aa, Homo Sapiens
AESFKSEHT

SEQ ID NO: 1381022 - protein, 9 aa, Homo Sapiens
TRKEHWIHF

SEQ ID NO: 1381023 - protein, 9 aa, Homo Sapiens
APAAVLFVC

SEQ ID NO: 1381024 - protein, 9 aa, Homo Sapiens
SSHKEDTDG

SEQ ID NO: 1381025 - protein, 9 aa, Homo Sapiens
ETSWGLETN

SEQ ID NO: 1381026 - protein, 9 aa, Homo Sapiens
TAAVGKARR

SEQ ID NO: 1381027 - protein, 9 aa, Homo Sapiens
TEIKDGEFK

SEQ ID NO: 1381028 - protein, 9 aa, Homo Sapiens
FIIDGRSQG

SEQ ID NO: 1381029 - protein, 9 aa, Homo Sapiens
HSEFDGQHG

SEQ ID NO: 1381030 - protein, 9 aa, Homo Sapiens
FSLMAKGSQ

SEQ ID NO: 1381031 - protein, 9 aa, Homo Sapiens
YPEFESMGD

SEQ ID NO: 1381032 - protein, 9 aa, Homo Sapiens
LRSEKSSYQ

SEQ ID NO: 1381033 - protein, 9 aa, Homo Sapiens
PSAQGGRAA

SEQ ID NO: 1381034 - protein, 9 aa, Homo Sapiens
VMMWMGGKT

SEQ ID NO: 1381035 - protein, 9 aa, Homo Sapiens
KSQLSLSLL

SEQ ID NO: 1381036 - protein, 9 aa, Homo Sapiens
QAFIKFLSE

SEQ ID NO: 1381037 - protein, 9 aa, Homo Sapiens
NDTHVDEDL

SEQ ID NO: 1381038 - protein, 9 aa, Homo Sapiens
KIPEQFRHV

SEQ ID NO: 1381039 - protein, 9 aa, Homo Sapiens
WNGELVTGL

SEQ ID NO: 1381040 - protein, 9 aa, Homo Sapiens
NIHFITWRK

SEQ ID NO: 1381041 - protein, 9 aa, Homo Sapiens
PRTNSPQAR

SEQ ID NO: 1381042 - protein, 9 aa, Homo Sapiens
GEGLIPGDG

SEQ ID NO: 1381043 - protein, 9 aa, Homo Sapiens
RIKTPPKCP

SEQ ID NO: 1381044 - protein, 9 aa, Homo Sapiens
ANRTVLENP

SEQ ID NO: 1381045 - protein, 9 aa, Homo Sapiens
LVTIRSICQ

SEQ ID NO: 1381046 - protein, 9 aa, Homo Sapiens
LSAPLPILC

SEQ ID NO: 1381047 - protein, 9 aa, Homo Sapiens
SVKEMDEEG

SEQ ID NO: 1381048 - protein, 9 aa, Homo Sapiens
EPVGNREKI

SEQ ID NO: 1381049 - protein, 9 aa, Homo Sapiens
YLKKKQEPP

SEQ ID NO: 1381050 - protein, 9 aa, Homo Sapiens
PRFSSVVGL

SEQ ID NO: 1381051 - protein, 9 aa, Homo Sapiens
IIGSYTIVL

SEQ ID NO: 1381052 - protein, 9 aa, Homo Sapiens
ECWSTYSLP

SEQ ID NO: 1381053 - protein, 9 aa, Homo Sapiens
CGLCHGGRH

SEQ ID NO: 1381054 - protein, 9 aa, Homo Sapiens
VSSLRCHRH

SEQ ID NO: 1381055 - protein, 9 aa, Homo Sapiens
GQASPPAAR

SEQ ID NO: 1381056 - protein, 9 aa, Homo Sapiens
FGGGEYGGG

SEQ ID NO: 1381057 - protein, 9 aa, Homo Sapiens
ENLAGWRPL

SEQ ID NO: 1381058 - protein, 9 aa, Homo Sapiens
AVKIDGLTM

SEQ ID NO: 1381059 - protein, 9 aa, Homo Sapiens
KRATTEDLQ

SEQ ID NO: 1381060 - protein, 9 aa, Homo Sapiens
PNKGFDLCV

SEQ ID NO: 1381061 - protein, 9 aa, Homo Sapiens
LACASDHVK

SEQ ID NO: 1381062 - protein, 9 aa, Homo Sapiens
YDAYGPAGF

SEQ ID NO: 1381063 - protein, 9 aa, Homo Sapiens
TSVEVTVAG

SEQ ID NO: 1381064 - protein, 9 aa, Homo Sapiens
NSVMVGTEE

SEQ ID NO: 1381065 - protein, 9 aa, Homo Sapiens
APVECQLGH

SEQ ID NO: 1381066 - protein, 9 aa, Homo Sapiens
TCVTSCCRP

SEQ ID NO: 1381067 - protein, 9 aa, Homo Sapiens
HYRIHTGKK

SEQ ID NO: 1381068 - protein, 9 aa, Homo Sapiens
VQELLPNCI

SEQ ID NO: 1381069 - protein, 9 aa, Homo Sapiens
ATVLFIITN

SEQ ID NO: 1381070 - protein, 9 aa, Homo Sapiens
SAWAPRSSC

SEQ ID NO: 1381071 - protein, 9 aa, Homo Sapiens
KKKQISRSS

SEQ ID NO: 1381072 - protein, 9 aa, Homo Sapiens
LNSQNCISL

SEQ ID NO: 1381073 - protein, 9 aa, Homo Sapiens
MTFTTFDMG

SEQ ID NO: 1381074 - protein, 9 aa, Homo Sapiens
QLGHPAGGH

SEQ ID NO: 1381075 - protein, 9 aa, Homo Sapiens
VLQAFLPDM

SEQ ID NO: 1381076 - protein, 9 aa, Homo Sapiens
TPPEGWKLL

SEQ ID NO: 1381077 - protein, 9 aa, Homo Sapiens
SHVVRLCRA

SEQ ID NO: 1381078 - protein, 9 aa, Homo Sapiens
SNPPRHPSI

SEQ ID NO: 1381079 - protein, 9 aa, Homo Sapiens
AEEPVEGAV

SEQ ID NO: 1381080 - protein, 9 aa, Homo Sapiens
ENARSPPQL

SEQ ID NO: 1381081 - protein, 9 aa, Homo Sapiens
VNIQVRKKQ

SEQ ID NO: 1381082 - protein, 9 aa, Homo Sapiens
PITPASGLH

SEQ ID NO: 1381083 - protein, 9 aa, Homo Sapiens
LSVKNVADT

SEQ ID NO: 1381084 - protein, 9 aa, Homo Sapiens
AKVQDKEGI

SEQ ID NO: 1381085 - protein, 9 aa, Homo Sapiens
DCMKGGKCQ

SEQ ID NO: 1381086 - protein, 9 aa, Homo Sapiens
KSAECKSRG

SEQ ID NO: 1381087 - protein, 9 aa, Homo Sapiens
ALCLGCCGL

SEQ ID NO: 1381088 - protein, 9 aa, Homo Sapiens
PLTPGVHEG

SEQ ID NO: 1381089 - protein, 9 aa, Homo Sapiens
PILCVFVTP

SEQ ID NO: 1381090 - protein, 9 aa, Homo Sapiens
VQGQAAHPT

SEQ ID NO: 1381091 - protein, 9 aa, Homo Sapiens
AVLFVCTLH

SEQ ID NO: 1381092 - protein, 9 aa, Homo Sapiens
PRSSCRAVG

SEQ ID NO: 1381093 - protein, 9 aa, Homo Sapiens
LQGIQFSDR

SEQ ID NO: 1381094 - protein, 9 aa, Homo Sapiens
GLAVPARLR

SEQ ID NO: 1381095 - protein, 9 aa, Homo Sapiens
SQNCEDAQA

SEQ ID NO: 1381096 - protein, 9 aa, Homo Sapiens
IDVAQKKIQ

SEQ ID NO: 1381097 - protein, 9 aa, Homo Sapiens
LECRTHRAV

SEQ ID NO: 1381098 - protein, 9 aa, Homo Sapiens
VAQENQGGV

SEQ ID NO: 1381099 - protein, 9 aa, Homo Sapiens
GKFQLPGQK

SEQ ID NO: 1381100 - protein, 9 aa, Homo Sapiens
PLTLSLHRW

SEQ ID NO: 1381101 - protein, 9 aa, Homo Sapiens
KTKRATTED

SEQ ID NO: 1381102 - protein, 9 aa, Homo Sapiens
RGAATRMGT

SEQ ID NO: 1381103 - protein, 9 aa, Homo Sapiens
AQGGRAAEE

SEQ ID NO: 1381104 - protein, 9 aa, Homo Sapiens
EAHKRGSHF

SEQ ID NO: 1381105 - protein, 9 aa, Homo Sapiens
VPRMIVTPP

SEQ ID NO: 1381106 - protein, 9 aa, Homo Sapiens
CRDPRSSSK

SEQ ID NO: 1381107 - protein, 9 aa, Homo Sapiens
HSSAQIHQE

SEQ ID NO: 1381108 - protein, 9 aa, Homo Sapiens
LIMSLDHFL

SEQ ID NO: 1381109 - protein, 9 aa, Homo Sapiens
MVMMWMGGK

SEQ ID NO: 1381110 - protein, 9 aa, Homo Sapiens
SSPTRRRRQ

SEQ ID NO: 1381111 - protein, 9 aa, Homo Sapiens
WIGNERLPS

SEQ ID NO: 1381112 - protein, 9 aa, Homo Sapiens
PPFPAKVQG

SEQ ID NO: 1381113 - protein, 9 aa, Homo Sapiens
MSLDHFLAI

SEQ ID NO: 1381114 - protein, 9 aa, Homo Sapiens
CKDCMKGGK

SEQ ID NO: 1381115 - protein, 9 aa, Homo Sapiens
RPLGDSLIL

SEQ ID NO: 1381116 - protein, 9 aa, Homo Sapiens
VVRNLAALC

SEQ ID NO: 1381117 - protein, 9 aa, Homo Sapiens
GSQRKEELS

SEQ ID NO: 1381118 - protein, 9 aa, Homo Sapiens
KHERIRLGL

SEQ ID NO: 1381119 - protein, 9 aa, Homo Sapiens
PIPPYPASS

SEQ ID NO: 1381120 - protein, 9 aa, Homo Sapiens
WGHLVRIKP

SEQ ID NO: 1381121 - protein, 9 aa, Homo Sapiens
VPLGETHSH

SEQ ID NO: 1381122 - protein, 9 aa, Homo Sapiens
AKGELRYYF

SEQ ID NO: 1381123 - protein, 9 aa, Homo Sapiens
RPLPVDAGE

SEQ ID NO: 1381124 - protein, 9 aa, Homo Sapiens
EKGIMVSAG

SEQ ID NO: 1381125 - protein, 9 aa, Homo Sapiens
RGDLGYLVE

SEQ ID NO: 1381126 - protein, 9 aa, Homo Sapiens
QNSCSCSNL

SEQ ID NO: 1381127 - protein, 9 aa, Homo Sapiens
QQPTDPHRL

SEQ ID NO: 1381128 - protein, 9 aa, Homo Sapiens
EGIDREYKD

SEQ ID NO: 1381129 - protein, 9 aa, Homo Sapiens
EAAAVVMVV

SEQ ID NO: 1381130 - protein, 9 aa, Homo Sapiens
EMVPLGETH

SEQ ID NO: 1381131 - protein, 9 aa, Homo Sapiens
VGTVRVLQA

SEQ ID NO: 1381132 - protein, 9 aa, Homo Sapiens
SPHASLRNI

SEQ ID NO: 1381133 - protein, 9 aa, Homo Sapiens
GGDCPKGPQ

SEQ ID NO: 1381134 - protein, 9 aa, Homo Sapiens
LNEALPLFL

SEQ ID NO: 1381135 - protein, 9 aa, Homo Sapiens
ALMPPVPCM

SEQ ID NO: 1381136 - protein, 9 aa, Homo Sapiens
IVEMKSEKR

SEQ ID NO: 1381137 - protein, 9 aa, Homo Sapiens
KRILLSLLC

SEQ ID NO: 1381138 - protein, 9 aa, Homo Sapiens
GAFGQFWGG

SEQ ID NO: 1381139 - protein, 9 aa, Homo Sapiens
DLHSEFDGQ

SEQ ID NO: 1381140 - protein, 9 aa, Homo Sapiens
GSALLQAPL

SEQ ID NO: 1381141 - protein, 9 aa, Homo Sapiens
DSSQSDPET

SEQ ID NO: 1381142 - protein, 9 aa, Homo Sapiens
IFALLELLE

SEQ ID NO: 1381143 - protein, 9 aa, Homo Sapiens
TVPGLWMLA

SEQ ID NO: 1381144 - protein, 9 aa, Homo Sapiens
RDPRSSSKA

SEQ ID NO: 1381145 - protein, 9 aa, Homo Sapiens
GGFGGGEYG

SEQ ID NO: 1381146 - protein, 9 aa, Homo Sapiens
STRTVPTTF

SEQ ID NO: 1381147 - protein, 9 aa, Homo Sapiens
VDIHLWQPD

SEQ ID NO: 1381148 - protein, 9 aa, Homo Sapiens
SFSHHSVSV

SEQ ID NO: 1381149 - protein, 9 aa, Homo Sapiens
RKNHSSRLT

SEQ ID NO: 1381150 - protein, 9 aa, Homo Sapiens
VLKKKTGSN

SEQ ID NO: 1381151 - protein, 9 aa, Homo Sapiens
IPQRSAPGT

SEQ ID NO: 1381152 - protein, 9 aa, Homo Sapiens
GDEIGRKVY

SEQ ID NO: 1381153 - protein, 9 aa, Homo Sapiens
PLTGWAASP

SEQ ID NO: 1381154 - protein, 9 aa, Homo Sapiens
CPFIPRRAK

SEQ ID NO: 1381155 - protein, 9 aa, Homo Sapiens
FTLRKKTCL

SEQ ID NO: 1381156 - protein, 9 aa, Homo Sapiens
RQRRTVTCQ

SEQ ID NO: 1381157 - protein, 9 aa, Homo Sapiens
WEQIYATAK

SEQ ID NO: 1381158 - protein, 9 aa, Homo Sapiens
LKDIALVMQ

SEQ ID NO: 1381159 - protein, 9 aa, Homo Sapiens
SCRNVWSLP

SEQ ID NO: 1381160 - protein, 9 aa, Homo Sapiens
RHAWPITPT

SEQ ID NO: 1381161 - protein, 9 aa, Homo Sapiens
DDNCQAFIK

SEQ ID NO: 1381162 - protein, 9 aa, Homo Sapiens
HGTIDSLPN

SEQ ID NO: 1381163 - protein, 9 aa, Homo Sapiens
PPPSQTARA

SEQ ID NO: 1381164 - protein, 9 aa, Homo Sapiens
PLSPAPSTP

SEQ ID NO: 1381165 - protein, 9 aa, Homo Sapiens
RSWTRTCPR

SEQ ID NO: 1381166 - protein, 9 aa, Homo Sapiens
VADHLGLGW

SEQ ID NO: 1381167 - protein, 9 aa, Homo Sapiens
QHDTDEKYN

SEQ ID NO: 1381168 - protein, 9 aa, Homo Sapiens
YQIEKMFLQ

SEQ ID NO: 1381169 - protein, 9 aa, Homo Sapiens
YLLVQYIIM

SEQ ID NO: 1381170 - protein, 9 aa, Homo Sapiens
GRLFILCGL

SEQ ID NO: 1381171 - protein, 9 aa, Homo Sapiens
ETHESHVVR

SEQ ID NO: 1381172 - protein, 9 aa, Homo Sapiens
LGLGWTELA

SEQ ID NO: 1381173 - protein, 9 aa, Homo Sapiens
CHGQVQGQQ

SEQ ID NO: 1381174 - protein, 9 aa, Homo Sapiens
LWPEDRPLP

SEQ ID NO: 1381175 - protein, 9 aa, Homo Sapiens
SLMAKGSQR

SEQ ID NO: 1381176 - protein, 9 aa, Homo Sapiens
QRDRLESEG

SEQ ID NO: 1381177 - protein, 9 aa, Homo Sapiens
LAVPARLRH

SEQ ID NO: 1381178 - protein, 9 aa, Homo Sapiens
GAQALMPPV

SEQ ID NO: 1381179 - protein, 9 aa, Homo Sapiens
GKCLADGAD

SEQ ID NO: 1381180 - protein, 9 aa, Homo Sapiens
LQAQQRHQR

SEQ ID NO: 1381181 - protein, 9 aa, Homo Sapiens
WHRELQRPQ

SEQ ID NO: 1381182 - protein, 9 aa, Homo Sapiens
QNFTDPQLH

SEQ ID NO: 1381183 - protein, 9 aa, Homo Sapiens
FHAEKLAAV

SEQ ID NO: 1381184 - protein, 9 aa, Homo Sapiens
LSLSLLLWP

SEQ ID NO: 1381185 - protein, 9 aa, Homo Sapiens
VRPISRGAF

SEQ ID NO: 1381186 - protein, 9 aa, Homo Sapiens
FVLVNLEVT

SEQ ID NO: 1381187 - protein, 9 aa, Homo Sapiens
THPKEGQEV

SEQ ID NO: 1381188 - protein, 9 aa, Homo Sapiens
MASNSLFNT

SEQ ID NO: 1381189 - protein, 9 aa, Homo Sapiens
QFSDRLKLF

SEQ ID NO: 1381190 - protein, 9 aa, Homo Sapiens
HGPLTGWAA

SEQ ID NO: 1381191 - protein, 9 aa, Homo Sapiens
TTSSERGER

SEQ ID NO: 1381192 - protein, 9 aa, Homo Sapiens
ARTFVVFVQ

SEQ ID NO: 1381193 - protein, 9 aa, Homo Sapiens
SNLSVKNVA

SEQ ID NO: 1381194 - protein, 9 aa, Homo Sapiens
MPPRQAQCL

SEQ ID NO: 1381195 - protein, 9 aa, Homo Sapiens
SVYHEKILI

SEQ ID NO: 1381196 - protein, 9 aa, Homo Sapiens
PQLLFSSLE

SEQ ID NO: 1381197 - protein, 9 aa, Homo Sapiens
GYSTPTSPT

SEQ ID NO: 1381198 - protein, 9 aa, Homo Sapiens
KTCRWQCIE

SEQ ID NO: 1381199 - protein, 9 aa, Homo Sapiens
HGAFQAQRA

SEQ ID NO: 1381200 - protein, 9 aa, Homo Sapiens
MKGGKCQEG

SEQ ID NO: 1381201 - protein, 9 aa, Homo Sapiens
IFLTEGLST

SEQ ID NO: 1381202 - protein, 9 aa, Homo Sapiens
VKRGPGNQL

SEQ ID NO: 1381203 - protein, 9 aa, Homo Sapiens
LALHLQAQQ

SEQ ID NO: 1381204 - protein, 9 aa, Homo Sapiens
LTINLLEEL

SEQ ID NO: 1381205 - protein, 9 aa, Homo Sapiens
IAITKCCGL

SEQ ID NO: 1381206 - protein, 9 aa, Homo Sapiens
SPRSWTRTC

SEQ ID NO: 1381207 - protein, 9 aa, Homo Sapiens
STCWQGWAL

SEQ ID NO: 1381208 - protein, 9 aa, Homo Sapiens
DIDNVTVLE

SEQ ID NO: 1381209 - protein, 9 aa, Homo Sapiens
EGSLWPEDR

SEQ ID NO: 1381210 - protein, 9 aa, Homo Sapiens
RLFILCGLG

SEQ ID NO: 1381211 - protein, 9 aa, Homo Sapiens
WAGRPWEPS

SEQ ID NO: 1381212 - protein, 9 aa, Homo Sapiens
TLTIQVLPA

SEQ ID NO: 1381213 - protein, 9 aa, Homo Sapiens
YAATRDNCC

SEQ ID NO: 1381214 - protein, 9 aa, Homo Sapiens
CCGLCHGGR

SEQ ID NO: 1381215 - protein, 9 aa, Homo Sapiens
PTCAQLFTT

SEQ ID NO: 1381216 - protein, 9 aa, Homo Sapiens
LWPAVPVKR

SEQ ID NO: 1381217 - protein, 9 aa, Homo Sapiens
NQIRATPEA

SEQ ID NO: 1381218 - protein, 9 aa, Homo Sapiens
RRKSKYNED

SEQ ID NO: 1381219 - protein, 9 aa, Homo Sapiens
STTGSQRIE

SEQ ID NO: 1381220 - protein, 9 aa, Homo Sapiens
IGGSLGSFV

SEQ ID NO: 1381221 - protein, 9 aa, Homo Sapiens
QEKGSVSTI

SEQ ID NO: 1381222 - protein, 9 aa, Homo Sapiens
HLACASDHV

SEQ ID NO: 1381223 - protein, 9 aa, Homo Sapiens
RPSCYSQVN

SEQ ID NO: 1381224 - protein, 9 aa, Homo Sapiens
EPGPRPTAT

SEQ ID NO: 1381225 - protein, 9 aa, Homo Sapiens
ELRRLGDEI

SEQ ID NO: 1381226 - protein, 9 aa, Homo Sapiens
AKRQHNFTL

SEQ ID NO: 1381227 - protein, 9 aa, Homo Sapiens
AEYIDSNHT

SEQ ID NO: 1381228 - protein, 9 aa, Homo Sapiens
EEEGFDWSD

SEQ ID NO: 1381229 - protein, 9 aa, Homo Sapiens
PQQRLGELE

SEQ ID NO: 1381230 - protein, 9 aa, Homo Sapiens
EDWGGPEVP

SEQ ID NO: 1381231 - protein, 9 aa, Homo Sapiens
EQQCELRVQ

SEQ ID NO: 1381232 - protein, 9 aa, Homo Sapiens
VLNQIRATP

SEQ ID NO: 1381233 - protein, 9 aa, Homo Sapiens
TATRRFSQV

SEQ ID NO: 1381234 - protein, 9 aa, Homo Sapiens
PKEDAGDPV

SEQ ID NO: 1381235 - protein, 9 aa, Homo Sapiens
SQIIENVDV

SEQ ID NO: 1381236 - protein, 9 aa, Homo Sapiens
SVIYASQTE

SEQ ID NO: 1381237 - protein, 9 aa, Homo Sapiens
VLENPRNGT

SEQ ID NO: 1381238 - protein, 9 aa, Homo Sapiens
AQKKIQDVS

SEQ ID NO: 1381239 - protein, 9 aa, Homo Sapiens
CSCSNLTSS

SEQ ID NO: 1381240 - protein, 9 aa, Homo Sapiens
STIVDCSNQ

SEQ ID NO: 1381241 - protein, 9 aa, Homo Sapiens
QKSLKDEEQ

SEQ ID NO: 1381242 - protein, 9 aa, Homo Sapiens
AREGSLWPE

SEQ ID NO: 1381243 - protein, 9 aa, Homo Sapiens
LGANLNIKI

SEQ ID NO: 1381244 - protein, 9 aa, Homo Sapiens
RYVALKLKL

SEQ ID NO: 1381245 - protein, 9 aa, Homo Sapiens
DREREGKGK

SEQ ID NO: 1381246 - protein, 9 aa, Homo Sapiens
KLGASGQES

SEQ ID NO: 1381247 - protein, 9 aa, Homo Sapiens
CAQLFTTRK

SEQ ID NO: 1381248 - protein, 9 aa, Homo Sapiens
AYMLSVTGN

SEQ ID NO: 1381249 - protein, 9 aa, Homo Sapiens
EKRTACAQK

SEQ ID NO: 1381250 - protein, 9 aa, Homo Sapiens
RKKQKHETR

SEQ ID NO: 1381251 - protein, 9 aa, Homo Sapiens
SHMGAPPAG

SEQ ID NO: 1381252 - protein, 9 aa, Homo Sapiens
EVGLLPRVM

SEQ ID NO: 1381253 - protein, 9 aa, Homo Sapiens
TIQVLPAPS

SEQ ID NO: 1381254 - protein, 9 aa, Homo Sapiens
VHLGSGYWL

SEQ ID NO: 1381255 - protein, 9 aa, Homo Sapiens
HRTKVCAVP

SEQ ID NO: 1381256 - protein, 9 aa, Homo Sapiens
PCPENSLPP

SEQ ID NO: 1381257 - protein, 9 aa, Homo Sapiens
FKGRVSMCA

SEQ ID NO: 1381258 - protein, 9 aa, Homo Sapiens
GLIKAFHED

SEQ ID NO: 1381259 - protein, 9 aa, Homo Sapiens
RRGQDLAFQ

SEQ ID NO: 1381260 - protein, 9 aa, Homo Sapiens
SLNYFLMCA

SEQ ID NO: 1381261 - protein, 9 aa, Homo Sapiens
LQFSLMAKG

SEQ ID NO: 1381262 - protein, 9 aa, Homo Sapiens
PPEAITLCS

SEQ ID NO: 1381263 - protein, 9 aa, Homo Sapiens
IHQERRLPG

SEQ ID NO: 1381264 - protein, 9 aa, Homo Sapiens
EFLGAAAAV

SEQ ID NO: 1381265 - protein, 9 aa, Homo Sapiens
PLLTWQLWH

SEQ ID NO: 1381266 - protein, 9 aa, Homo Sapiens
ALSLSGGRR

SEQ ID NO: 1381267 - protein, 9 aa, Homo Sapiens
TCLYKYVFC

SEQ ID NO: 1381268 - protein, 9 aa, Homo Sapiens
GNQLRNHYI

SEQ ID NO: 1381269 - protein, 9 aa, Homo Sapiens
KCPDYDRMS

SEQ ID NO: 1381270 - protein, 9 aa, Homo Sapiens
TVKKFRTWV

SEQ ID NO: 1381271 - protein, 9 aa, Homo Sapiens
IVTGGVSPV

SEQ ID NO: 1381272 - protein, 9 aa, Homo Sapiens
SSTCVAYAA

SEQ ID NO: 1381273 - protein, 9 aa, Homo Sapiens
ELWIAITKC

SEQ ID NO: 1381274 - protein, 9 aa, Homo Sapiens
KKIQDVSMK

SEQ ID NO: 1381275 - protein, 9 aa, Homo Sapiens
LLLNDSNIT

SEQ ID NO: 1381276 - protein, 9 aa, Homo Sapiens
FGKNDCKFC

SEQ ID NO: 1381277 - protein, 9 aa, Homo Sapiens
EKTVQCYWR

SEQ ID NO: 1381278 - protein, 9 aa, Homo Sapiens
TLATMFSIG

SEQ ID NO: 1381279 - protein, 9 aa, Homo Sapiens
VRKKQKHET

SEQ ID NO: 1381280 - protein, 9 aa, Homo Sapiens
QQSSSDCNI

SEQ ID NO: 1381281 - protein, 9 aa, Homo Sapiens
FVVFTVLGY

SEQ ID NO: 1381282 - protein, 9 aa, Homo Sapiens
HVWTPADQR

SEQ ID NO: 1381283 - protein, 9 aa, Homo Sapiens
TLEGACGPK

SEQ ID NO: 1381284 - protein, 9 aa, Homo Sapiens
QMKCLEQQC

SEQ ID NO: 1381285 - protein, 9 aa, Homo Sapiens
VVRLCRARE

SEQ ID NO: 1381286 - protein, 9 aa, Homo Sapiens
LPVDAGEDG

SEQ ID NO: 1381287 - protein, 9 aa, Homo Sapiens
LLFSDSSQS

SEQ ID NO: 1381288 - protein, 9 aa, Homo Sapiens
ATPEASAIT

SEQ ID NO: 1381289 - protein, 9 aa, Homo Sapiens
KHETRRKSK

SEQ ID NO: 1381290 - protein, 9 aa, Homo Sapiens
GGARAGAFL

SEQ ID NO: 1381291 - protein, 9 aa, Homo Sapiens
TTRYEEKKT

SEQ ID NO: 1381292 - protein, 9 aa, Homo Sapiens
TGWDSRCAP

SEQ ID NO: 1381293 - protein, 9 aa, Homo Sapiens
DPRLNKVLY

SEQ ID NO: 1381294 - protein, 9 aa, Homo Sapiens
AFIKFLSEL

SEQ ID NO: 1381295 - protein, 9 aa, Homo Sapiens
LEALQLGRN

SEQ ID NO: 1381296 - protein, 9 aa, Homo Sapiens
QFIIDGRSQ

SEQ ID NO: 1381297 - protein, 9 aa, Homo Sapiens
REEREREKK

SEQ ID NO: 1381298 - protein, 9 aa, Homo Sapiens
PASPLLLSP

SEQ ID NO: 1381299 - protein, 9 aa, Homo Sapiens
RWSLSCRNV

SEQ ID NO: 1381300 - protein, 9 aa, Homo Sapiens
TEGLSTLSQ

SEQ ID NO: 1381301 - protein, 9 aa, Homo Sapiens
GIMVSAGDT

SEQ ID NO: 1381302 - protein, 9 aa, Homo Sapiens
NCTYQEGQW

SEQ ID NO: 1381303 - protein, 9 aa, Homo Sapiens
ASTPDNQGR

SEQ ID NO: 1381304 - protein, 9 aa, Homo Sapiens
LFIIGSYTI

SEQ ID NO: 1381305 - protein, 9 aa, Homo Sapiens
EGNLSMEDF

SEQ ID NO: 1381306 - protein, 9 aa, Homo Sapiens
QIHQERRLP

SEQ ID NO: 1381307 - protein, 9 aa, Homo Sapiens
GIALQSTTG

SEQ ID NO: 1381308 - protein, 9 aa, Homo Sapiens
NARLTATRR

SEQ ID NO: 1381309 - protein, 9 aa, Homo Sapiens
APGQTPELA

SEQ ID NO: 1381310 - protein, 9 aa, Homo Sapiens
QLHRIIGAV

SEQ ID NO: 1381311 - protein, 9 aa, Homo Sapiens
ERGERAHFG

SEQ ID NO: 1381312 - protein, 9 aa, Homo Sapiens
RLIELAESF

SEQ ID NO: 1381313 - protein, 9 aa, Homo Sapiens
GHQRPFLEL

SEQ ID NO: 1381314 - protein, 9 aa, Homo Sapiens
KKVKEDEDG

SEQ ID NO: 1381315 - protein, 9 aa, Homo Sapiens
ISLTTPGPT

SEQ ID NO: 1381316 - protein, 9 aa, Homo Sapiens
SIGCAKQTK

SEQ ID NO: 1381317 - protein, 9 aa, Homo Sapiens
HCSEVSEIF

SEQ ID NO: 1381318 - protein, 9 aa, Homo Sapiens
GENRRIPIN

SEQ ID NO: 1381319 - protein, 9 aa, Homo Sapiens
WDSRCAPGT

SEQ ID NO: 1381320 - protein, 9 aa, Homo Sapiens
GSNDIEGID

SEQ ID NO: 1381321 - protein, 9 aa, Homo Sapiens
KKRIPQDIC

SEQ ID NO: 1381322 - protein, 9 aa, Homo Sapiens
FGGEHVPSS

SEQ ID NO: 1381323 - protein, 9 aa, Homo Sapiens
GVSPVRDLD

SEQ ID NO: 1381324 - protein, 9 aa, Homo Sapiens
KKKEAYSAA

SEQ ID NO: 1381325 - protein, 9 aa, Homo Sapiens
VSPEAIQID

SEQ ID NO: 1381326 - protein, 9 aa, Homo Sapiens
PAKVPPQEG

SEQ ID NO: 1381327 - protein, 9 aa, Homo Sapiens
LKGAMAQHE

SEQ ID NO: 1381328 - protein, 9 aa, Homo Sapiens
GLGKGNKSL

SEQ ID NO: 1381329 - protein, 9 aa, Homo Sapiens
QGPNKGFDL

SEQ ID NO: 1381330 - protein, 9 aa, Homo Sapiens
EALTKKKER

SEQ ID NO: 1381331 - protein, 9 aa, Homo Sapiens
AVGPSEAPG

SEQ ID NO: 1381332 - protein, 9 aa, Homo Sapiens
LMLSMGGPE

SEQ ID NO: 1381333 - protein, 9 aa, Homo Sapiens
LYQIEKMFL

SEQ ID NO: 1381334 - protein, 9 aa, Homo Sapiens
ARLRHLLCH

SEQ ID NO: 1381335 - protein, 9 aa, Homo Sapiens
DMAQAKVFG

SEQ ID NO: 1381336 - protein, 9 aa, Homo Sapiens
ETHAEMVHG

SEQ ID NO: 1381337 - protein, 9 aa, Homo Sapiens
NDNNIENAF

SEQ ID NO: 1381338 - protein, 9 aa, Homo Sapiens
CPSKKTKRA

SEQ ID NO: 1381339 - protein, 9 aa, Homo Sapiens
RRLGDEIGR

SEQ ID NO: 1381340 - protein, 9 aa, Homo Sapiens
ADLLFSDSS

SEQ ID NO: 1381341 - protein, 9 aa, Homo Sapiens
KKCPCRTLQ

SEQ ID NO: 1381342 - protein, 9 aa, Homo Sapiens
SSYGTIIME

SEQ ID NO: 1381343 - protein, 9 aa, Homo Sapiens
ADAYQSVHT

SEQ ID NO: 1381344 - protein, 9 aa, Homo Sapiens
ACDSITSNV

SEQ ID NO: 1381345 - protein, 9 aa, Homo Sapiens
RHNHLIKTA

SEQ ID NO: 1381346 - protein, 9 aa, Homo Sapiens
LRQLEKIST

SEQ ID NO: 1381347 - protein, 9 aa, Homo Sapiens
AGTVHLGSG

SEQ ID NO: 1381348 - protein, 9 aa, Homo Sapiens
QAIQNPQAP

SEQ ID NO: 1381349 - protein, 9 aa, Homo Sapiens
DLEVAQENQ

SEQ ID NO: 1381350 - protein, 9 aa, Homo Sapiens
GKKILFHYP

SEQ ID NO: 1381351 - protein, 9 aa, Homo Sapiens
ALPLFLLLI

SEQ ID NO: 1381352 - protein, 9 aa, Homo Sapiens
KEMVPLGET

SEQ ID NO: 1381353 - protein, 9 aa, Homo Sapiens
LEEIEMSAT

SEQ ID NO: 1381354 - protein, 9 aa, Homo Sapiens
SDAQQARAV

SEQ ID NO: 1381355 - protein, 9 aa, Homo Sapiens
AQQWPCCMK

SEQ ID NO: 1381356 - protein, 9 aa, Homo Sapiens
HRVGANSTC

SEQ ID NO: 1381357 - protein, 9 aa, Homo Sapiens
PAAVLFVCT

SEQ ID NO: 1381358 - protein, 9 aa, Homo Sapiens
SPPECGPVV

SEQ ID NO: 1381359 - protein, 9 aa, Homo Sapiens
ELRYYFLVY

SEQ ID NO: 1381360 - protein, 9 aa, Homo Sapiens
LMANSTWGC

SEQ ID NO: 1381361 - protein, 9 aa, Homo Sapiens
SIIIILSLM

SEQ ID NO: 1381362 - protein, 9 aa, Homo Sapiens
AWLQLQPAV

SEQ ID NO: 1381363 - protein, 9 aa, Homo Sapiens
IPQQEVVDT

SEQ ID NO: 1381364 - protein, 9 aa, Homo Sapiens
FLQAVYLLV

SEQ ID NO: 1381365 - protein, 9 aa, Homo Sapiens
ETMARRLAY

SEQ ID NO: 1381366 - protein, 9 aa, Homo Sapiens
IEKYIMTCL

SEQ ID NO: 1381367 - protein, 9 aa, Homo Sapiens
KLPKKKKEA

SEQ ID NO: 1381368 - protein, 9 aa, Homo Sapiens
GADAYQSVH

SEQ ID NO: 1381369 - protein, 9 aa, Homo Sapiens
PKGSPPPSQ

SEQ ID NO: 1381370 - protein, 9 aa, Homo Sapiens
DTAWLQLQP

SEQ ID NO: 1381371 - protein, 9 aa, Homo Sapiens
KGLENWLLR

SEQ ID NO: 1381372 - protein, 9 aa, Homo Sapiens
GKAGTAAVA

SEQ ID NO: 1381373 - protein, 9 aa, Homo Sapiens
WRSGMDFDD

SEQ ID NO: 1381374 - protein, 9 aa, Homo Sapiens
PSPSQPKKC

SEQ ID NO: 1381375 - protein, 9 aa, Homo Sapiens
LGDSLILEH

SEQ ID NO: 1381376 - protein, 9 aa, Homo Sapiens
EKLWNGELV

SEQ ID NO: 1381377 - protein, 9 aa, Homo Sapiens
TACAQKKLG

SEQ ID NO: 1381378 - protein, 9 aa, Homo Sapiens
QTEGKKNLC

SEQ ID NO: 1381379 - protein, 9 aa, Homo Sapiens
EEIYFLSTN

SEQ ID NO: 1381380 - protein, 9 aa, Homo Sapiens
PGISQYLQN

SEQ ID NO: 1381381 - protein, 9 aa, Homo Sapiens
HFLAIHNPL

SEQ ID NO: 1381382 - protein, 9 aa, Homo Sapiens
NLAISLTTP

SEQ ID NO: 1381383 - protein, 9 aa, Homo Sapiens
FTTTLLNTP

SEQ ID NO: 1381384 - protein, 9 aa, Homo Sapiens
YKWTWEGCT

SEQ ID NO: 1381385 - protein, 9 aa, Homo Sapiens
RGLEEPGPR

SEQ ID NO: 1381386 - protein, 9 aa, Homo Sapiens
QPLLPVSQE

SEQ ID NO: 1381387 - protein, 9 aa, Homo Sapiens
KQKHETRRK

SEQ ID NO: 1381388 - protein, 9 aa, Homo Sapiens
GVVTILEAC

SEQ ID NO: 1381389 - protein, 9 aa, Homo Sapiens
MRSLKGAMA

SEQ ID NO: 1381390 - protein, 9 aa, Homo Sapiens
PTLTKHKRI

SEQ ID NO: 1381391 - protein, 9 aa, Homo Sapiens
VNGVINILQ

SEQ ID NO: 1381392 - protein, 9 aa, Homo Sapiens
HTTNCFGDS

SEQ ID NO: 1381393 - protein, 9 aa, Homo Sapiens
PEDRPLPVD

SEQ ID NO: 1381394 - protein, 9 aa, Homo Sapiens
NLQKHERIR

SEQ ID NO: 1381395 - protein, 9 aa, Homo Sapiens
WGGDCPKGP

SEQ ID NO: 1381396 - protein, 9 aa, Homo Sapiens
VYLKKKQIS

SEQ ID NO: 1381397 - protein, 9 aa, Homo Sapiens
PSVTGVSEL

SEQ ID NO: 1381398 - protein, 9 aa, Homo Sapiens
TQPKEGDIP

SEQ ID NO: 1381399 - protein, 9 aa, Homo Sapiens
LPGDFREVP

SEQ ID NO: 1381400 - protein, 9 aa, Homo Sapiens
IYSEHNYCR

SEQ ID NO: 1381401 - protein, 9 aa, Homo Sapiens
QSPHASLRN

SEQ ID NO: 1381402 - protein, 9 aa, Homo Sapiens
YIIRVVSFT

SEQ ID NO: 1381403 - protein, 9 aa, Homo Sapiens
EKRILLSLL

SEQ ID NO: 1381404 - protein, 9 aa, Homo Sapiens
CYLHACRHR

SEQ ID NO: 1381405 - protein, 9 aa, Homo Sapiens
SHIKEKLDD

SEQ ID NO: 1381406 - protein, 9 aa, Homo Sapiens
QVPSNPPRH

SEQ ID NO: 1381407 - protein, 9 aa, Homo Sapiens
GGPRRGWGT

SEQ ID NO: 1381408 - protein, 9 aa, Homo Sapiens
RRDPGHRQQ

SEQ ID NO: 1381409 - protein, 9 aa, Homo Sapiens
LHLACASDH

SEQ ID NO: 1381410 - protein, 9 aa, Homo Sapiens
PVEGAVIIP

SEQ ID NO: 1381411 - protein, 9 aa, Homo Sapiens
NTPSTAGLG

SEQ ID NO: 1381412 - protein, 9 aa, Homo Sapiens
FSDSGVCLC

SEQ ID NO: 1381413 - protein, 9 aa, Homo Sapiens
FLLVAYMLS

SEQ ID NO: 1381414 - protein, 9 aa, Homo Sapiens
QVSPHIQRQ

SEQ ID NO: 1381415 - protein, 9 aa, Homo Sapiens
GPPPYVFMC

SEQ ID NO: 1381416 - protein, 9 aa, Homo Sapiens
TLCSSLLEY

SEQ ID NO: 1381417 - protein, 9 aa, Homo Sapiens
RAPAKVPPQ

SEQ ID NO: 1381418 - protein, 9 aa, Homo Sapiens
AMLSFSEPS

SEQ ID NO: 1381419 - protein, 9 aa, Homo Sapiens
LLPVSQEFI

SEQ ID NO: 1381420 - protein, 9 aa, Homo Sapiens
LPAVNPWYV

SEQ ID NO: 1381421 - protein, 9 aa, Homo Sapiens
VVGLVTIVE

SEQ ID NO: 1381422 - protein, 9 aa, Homo Sapiens
GSGLGPQRK

SEQ ID NO: 1381423 - protein, 9 aa, Homo Sapiens
LTEGLSTLS

SEQ ID NO: 1381424 - protein, 9 aa, Homo Sapiens
LSFPLGVEF

SEQ ID NO: 1381425 - protein, 9 aa, Homo Sapiens
CGKAFSQNI

SEQ ID NO: 1381426 - protein, 9 aa, Homo Sapiens
NCISLSETR

SEQ ID NO: 1381427 - protein, 9 aa, Homo Sapiens
QGIQFSDRL

SEQ ID NO: 1381428 - protein, 9 aa, Homo Sapiens
ILCVFVTPS

SEQ ID NO: 1381429 - protein, 9 aa, Homo Sapiens
GVSELPGLP

SEQ ID NO: 1381430 - protein, 9 aa, Homo Sapiens
GLVAPPFPA

SEQ ID NO: 1381431 - protein, 9 aa, Homo Sapiens
WCNIHFITW

SEQ ID NO: 1381432 - protein, 9 aa, Homo Sapiens
ETMRSLKGA

SEQ ID NO: 1381433 - protein, 9 aa, Homo Sapiens
DGDFVIEME

SEQ ID NO: 1381434 - protein, 9 aa, Homo Sapiens
EGACGPKED

SEQ ID NO: 1381435 - protein, 9 aa, Homo Sapiens
HFDSLYFCF

SEQ ID NO: 1381436 - protein, 9 aa, Homo Sapiens
VEGKAGTAA

SEQ ID NO: 1381437 - protein, 9 aa, Homo Sapiens
LKKKQEPPC

SEQ ID NO: 1381438 - protein, 9 aa, Homo Sapiens
AFNFLLVWH

SEQ ID NO: 1381439 - protein, 9 aa, Homo Sapiens
EKISTTSSE

SEQ ID NO: 1381440 - protein, 9 aa, Homo Sapiens
KIWCNIHFI

SEQ ID NO: 1381441 - protein, 9 aa, Homo Sapiens
TVDGDVFRF

SEQ ID NO: 1381442 - protein, 9 aa, Homo Sapiens
DLEEMRKVL

SEQ ID NO: 1381443 - protein, 9 aa, Homo Sapiens
QEGPHIPGD

SEQ ID NO: 1381444 - protein, 9 aa, Homo Sapiens
PSVYSNVAR

SEQ ID NO: 1381445 - protein, 9 aa, Homo Sapiens
ISRQIPPFG

SEQ ID NO: 1381446 - protein, 9 aa, Homo Sapiens
HIKAKGAAV

SEQ ID NO: 1381447 - protein, 9 aa, Homo Sapiens
IEKNLIWQV

SEQ ID NO: 1381448 - protein, 9 aa, Homo Sapiens
PQNELWIAI

SEQ ID NO: 1381449 - protein, 9 aa, Homo Sapiens
DTKKNSIGE

SEQ ID NO: 1381450 - protein, 9 aa, Homo Sapiens
DGATVPLQH

SEQ ID NO: 1381451 - protein, 9 aa, Homo Sapiens
SQSQIIENV

SEQ ID NO: 1381452 - protein, 9 aa, Homo Sapiens
EDAQAIQNP

SEQ ID NO: 1381453 - protein, 9 aa, Homo Sapiens
NQGRSRAKV

SEQ ID NO: 1381454 - protein, 9 aa, Homo Sapiens
LIKRQQQKI

SEQ ID NO: 1381455 - protein, 9 aa, Homo Sapiens
MEDFLKTRV

SEQ ID NO: 1381456 - protein, 9 aa, Homo Sapiens
LVSPEAIQI

SEQ ID NO: 1381457 - protein, 9 aa, Homo Sapiens
DYGSGRLFI

SEQ ID NO: 1381458 - protein, 9 aa, Homo Sapiens
IDHSPRSWT

SEQ ID NO: 1381459 - protein, 9 aa, Homo Sapiens
IYFLSTNNA

SEQ ID NO: 1381460 - protein, 9 aa, Homo Sapiens
QTTISHSPL

SEQ ID NO: 1381461 - protein, 9 aa, Homo Sapiens
TAMLSFSEP

SEQ ID NO: 1381462 - protein, 9 aa, Homo Sapiens
DAVVASSSG

SEQ ID NO: 1381463 - protein, 9 aa, Homo Sapiens
ESTIVDCSN

SEQ ID NO: 1381464 - protein, 9 aa, Homo Sapiens
TTGSREVVG

SEQ ID NO: 1381465 - protein, 9 aa, Homo Sapiens
PMDSSYTKI

SEQ ID NO: 1381466 - protein, 9 aa, Homo Sapiens
KKPASEGSS

SEQ ID NO: 1381467 - protein, 9 aa, Homo Sapiens
NCQAFIKFL

SEQ ID NO: 1381468 - protein, 9 aa, Homo Sapiens
YVAPEVLRS

SEQ ID NO: 1381469 - protein, 9 aa, Homo Sapiens
PPIRRVSPG

SEQ ID NO: 1381470 - protein, 9 aa, Homo Sapiens
GRARGSKDF

SEQ ID NO: 1381471 - protein, 9 aa, Homo Sapiens
LLIMSLDHF

SEQ ID NO: 1381472 - protein, 9 aa, Homo Sapiens
QERRDPGHR

SEQ ID NO: 1381473 - protein, 9 aa, Homo Sapiens
THESHVVRL

SEQ ID NO: 1381474 - protein, 9 aa, Homo Sapiens
RACDSITSN

SEQ ID NO: 1381475 - protein, 9 aa, Homo Sapiens
FAKGELRYY

SEQ ID NO: 1381476 - protein, 9 aa, Homo Sapiens
CPCRTLQTS

SEQ ID NO: 1381477 - protein, 9 aa, Homo Sapiens
VVSFTELSR

SEQ ID NO: 1381478 - protein, 9 aa, Homo Sapiens
HTCPIRSEG

SEQ ID NO: 1381479 - protein, 9 aa, Homo Sapiens
PGVEGKAGT

SEQ ID NO: 1381480 - protein, 9 aa, Homo Sapiens
FILTRDMAQ

SEQ ID NO: 1381481 - protein, 9 aa, Homo Sapiens
PGCKWMDSL

SEQ ID NO: 1381482 - protein, 9 aa, Homo Sapiens
TSVASVYHE

SEQ ID NO: 1381483 - protein, 9 aa, Homo Sapiens
AATRDNCCI

SEQ ID NO: 1381484 - protein, 9 aa, Homo Sapiens
SNHGSLRQI

SEQ ID NO: 1381485 - protein, 9 aa, Homo Sapiens
LECWSTYSL

SEQ ID NO: 1381486 - protein, 9 aa, Homo Sapiens
RAYKVCTIR

SEQ ID NO: 1381487 - protein, 9 aa, Homo Sapiens
TCPRTNSPQ

SEQ ID NO: 1381488 - protein, 9 aa, Homo Sapiens
HLPLLTWQL

SEQ ID NO: 1381489 - protein, 9 aa, Homo Sapiens
TGEKPYKWT

SEQ ID NO: 1381490 - protein, 9 aa, Homo Sapiens
SCSCSNLTS

SEQ ID NO: 1381491 - protein, 9 aa, Homo Sapiens
SQTFPRESC

SEQ ID NO: 1381492 - protein, 9 aa, Homo Sapiens
RLGYEWDLV

SEQ ID NO: 1381493 - protein, 9 aa, Homo Sapiens
SPRPPPLVR

SEQ ID NO: 1381494 - protein, 9 aa, Homo Sapiens
HNHLIKTAQ

SEQ ID NO: 1381495 - protein, 9 aa, Homo Sapiens
SPEQTALHE

SEQ ID NO: 1381496 - protein, 9 aa, Homo Sapiens
AALAPALAL

SEQ ID NO: 1381497 - protein, 9 aa, Homo Sapiens
RNHYIIRVV

SEQ ID NO: 1381498 - protein, 9 aa, Homo Sapiens
STIALTLGV

SEQ ID NO: 1381499 - protein, 9 aa, Homo Sapiens
PLRDGGDHG

SEQ ID NO: 1381500 - protein, 9 aa, Homo Sapiens
LEVAQENQG

SEQ ID NO: 1381501 - protein, 9 aa, Homo Sapiens
RIPQDICPD

SEQ ID NO: 1381502 - protein, 9 aa, Homo Sapiens
NVTVLEYDA

SEQ ID NO: 1381503 - protein, 9 aa, Homo Sapiens
NSTCWQGWA

SEQ ID NO: 1381504 - protein, 9 aa, Homo Sapiens
LSIRCPAEL

SEQ ID NO: 1381505 - protein, 9 aa, Homo Sapiens
IEGWSHFDS

SEQ ID NO: 1381506 - protein, 9 aa, Homo Sapiens
YWRLLKALK

SEQ ID NO: 1381507 - protein, 9 aa, Homo Sapiens
WTRTCPRTN

SEQ ID NO: 1381508 - protein, 9 aa, Homo Sapiens
ILHSRVQLP

SEQ ID NO: 1381509 - protein, 9 aa, Homo Sapiens
MVGTEEEIS

SEQ ID NO: 1381510 - protein, 9 aa, Homo Sapiens
VAGRGPAAL

SEQ ID NO: 1381511 - protein, 9 aa, Homo Sapiens
QGRSANKFV

SEQ ID NO: 1381512 - protein, 9 aa, Homo Sapiens
QHGDEAAWT

SEQ ID NO: 1381513 - protein, 9 aa, Homo Sapiens
RGQDLAFQQ

SEQ ID NO: 1381514 - protein, 9 aa, Homo Sapiens
HPTDPGSPP

SEQ ID NO: 1381515 - protein, 9 aa, Homo Sapiens
RAKTAVRRA

SEQ ID NO: 1381516 - protein, 9 aa, Homo Sapiens
CRHRNESKS

SEQ ID NO: 1381517 - protein, 9 aa, Homo Sapiens
RKEPWKAKR

SEQ ID NO: 1381518 - protein, 9 aa, Homo Sapiens
VEETRCFIF

SEQ ID NO: 1381519 - protein, 9 aa, Homo Sapiens
EGKGKSQLS

SEQ ID NO: 1381520 - protein, 9 aa, Homo Sapiens
QPDNIAHIK

SEQ ID NO: 1381521 - protein, 9 aa, Homo Sapiens
CAERQDNKE

SEQ ID NO: 1381522 - protein, 9 aa, Homo Sapiens
SLPAREGSL

SEQ ID NO: 1381523 - protein, 9 aa, Homo Sapiens
IDNVTVLEY

SEQ ID NO: 1381524 - protein, 9 aa, Homo Sapiens
KWRSGMDFD

SEQ ID NO: 1381525 - protein, 9 aa, Homo Sapiens
LGARPLRGA

SEQ ID NO: 1381526 - protein, 9 aa, Homo Sapiens
PRLNKVLYP

SEQ ID NO: 1381527 - protein, 9 aa, Homo Sapiens
RKSKYNEDF

SEQ ID NO: 1381528 - protein, 9 aa, Homo Sapiens
VKFTPTSVI

SEQ ID NO: 1381529 - protein, 9 aa, Homo Sapiens
QPSVTGVSE

SEQ ID NO: 1381530 - protein, 9 aa, Homo Sapiens
GKAFKCSSA

SEQ ID NO: 1381531 - protein, 9 aa, Homo Sapiens
EKLAEVGKC

SEQ ID NO: 1381532 - protein, 9 aa, Homo Sapiens
FFVLVNLEV

SEQ ID NO: 1381533 - protein, 9 aa, Homo Sapiens
ATSIRWGAD

SEQ ID NO: 1381534 - protein, 9 aa, Homo Sapiens
LLKCPDYDR

SEQ ID NO: 1381535 - protein, 9 aa, Homo Sapiens
VTSVKEMDE

SEQ ID NO: 1381536 - protein, 9 aa, Homo Sapiens
ATLSPGEAR

SEQ ID NO: 1381537 - protein, 9 aa, Homo Sapiens
TVLFIITNC

SEQ ID NO: 1381538 - protein, 9 aa, Homo Sapiens
KSLAMTVTT

SEQ ID NO: 1381539 - protein, 9 aa, Homo Sapiens
NCEDAQAIQ

SEQ ID NO: 1381540 - protein, 9 aa, Homo Sapiens
LTSLGVIEE

SEQ ID NO: 1381541 - protein, 9 aa, Homo Sapiens
VYLLVQYII

SEQ ID NO: 1381542 - protein, 9 aa, Homo Sapiens
DAQAIQNPQ

SEQ ID NO: 1381543 - protein, 9 aa, Homo Sapiens
HQRPFLELK

SEQ ID NO: 1381544 - protein, 9 aa, Homo Sapiens
TRVSLLNTT

SEQ ID NO: 1381545 - protein, 9 aa, Homo Sapiens
NNIENAFLS

SEQ ID NO: 1381546 - protein, 9 aa, Homo Sapiens
TAVRRAAQQ

SEQ ID NO: 1381547 - protein, 9 aa, Homo Sapiens
IALQSTTGS

SEQ ID NO: 1381548 - protein, 9 aa, Homo Sapiens
SNEVTTRYE

SEQ ID NO: 1381549 - protein, 9 aa, Homo Sapiens
LPASPLLLS

SEQ ID NO: 1381550 - protein, 9 aa, Homo Sapiens
FAWMFFLVS

SEQ ID NO: 1381551 - protein, 9 aa, Homo Sapiens
APAKVPPQE

SEQ ID NO: 1381552 - protein, 9 aa, Homo Sapiens
GAVIIPGAD

SEQ ID NO: 1381553 - protein, 9 aa, Homo Sapiens
KIEDLLSIR

SEQ ID NO: 1381554 - protein, 9 aa, Homo Sapiens
RVLYQIEKM

SEQ ID NO: 1381555 - protein, 9 aa, Homo Sapiens
QNNRRELWS

SEQ ID NO: 1381556 - protein, 9 aa, Homo Sapiens
PSTPATPSS

SEQ ID NO: 1381557 - protein, 9 aa, Homo Sapiens
SAPPIRRVS

SEQ ID NO: 1381558 - protein, 9 aa, Homo Sapiens
ARLGYEWDL

SEQ ID NO: 1381559 - protein, 9 aa, Homo Sapiens
LQEWIDMTG

SEQ ID NO: 1381560 - protein, 9 aa, Homo Sapiens
TIRTQGLEC

SEQ ID NO: 1381561 - protein, 9 aa, Homo Sapiens
TPEASAITR

SEQ ID NO: 1381562 - protein, 9 aa, Homo Sapiens
PLGDSLILE

SEQ ID NO: 1381563 - protein, 9 aa, Homo Sapiens
APPKGSPPP

SEQ ID NO: 1381564 - protein, 9 aa, Homo Sapiens
RRAKTAVRR

SEQ ID NO: 1381565 - protein, 9 aa, Homo Sapiens
NLAGWRPLG

SEQ ID NO: 1381566 - protein, 9 aa, Homo Sapiens
DGQHGKKVP

SEQ ID NO: 1381567 - protein, 9 aa, Homo Sapiens
AAQQWPCCM

SEQ ID NO: 1381568 - protein, 9 aa, Homo Sapiens
PPKKKSFSF

SEQ ID NO: 1381569 - protein, 9 aa, Homo Sapiens
RRQRRTVTC

SEQ ID NO: 1381570 - protein, 9 aa, Homo Sapiens
YLKHRLSVV

SEQ ID NO: 1381571 - protein, 9 aa, Homo Sapiens
NAGDGFSFE

SEQ ID NO: 1381572 - protein, 9 aa, Homo Sapiens
EQEKEGIFF

SEQ ID NO: 1381573 - protein, 9 aa, Homo Sapiens
YTPIEGWSH

SEQ ID NO: 1381574 - protein, 9 aa, Homo Sapiens
VQHCNLARD

SEQ ID NO: 1381575 - protein, 9 aa, Homo Sapiens
CFSDSGVCL

SEQ ID NO: 1381576 - protein, 9 aa, Homo Sapiens
HQSAPPIRR

SEQ ID NO: 1381577 - protein, 9 aa, Homo Sapiens
PKEQEKEGI

SEQ ID NO: 1381578 - protein, 9 aa, Homo Sapiens
LTATRRFSQ

SEQ ID NO: 1381579 - protein, 9 aa, Homo Sapiens
KTFITSSYH

SEQ ID NO: 1381580 - protein, 9 aa, Homo Sapiens
QGKNHHHSE

SEQ ID NO: 1381581 - protein, 9 aa, Homo Sapiens
VTGGVSPVR

SEQ ID NO: 1381582 - protein, 9 aa, Homo Sapiens
ETRCFIFRR

SEQ ID NO: 1381583 - protein, 9 aa, Homo Sapiens
SCCRPSCCS

SEQ ID NO: 1381584 - protein, 9 aa, Homo Sapiens
RSICQQNSN

SEQ ID NO: 1381585 - protein, 9 aa, Homo Sapiens
EDLHSEFDG

SEQ ID NO: 1381586 - protein, 9 aa, Homo Sapiens
KGSWCLFCN

SEQ ID NO: 1381587 - protein, 9 aa, Homo Sapiens
CHVTTGKYL

SEQ ID NO: 1381588 - protein, 9 aa, Homo Sapiens
EGKAQWGGE

SEQ ID NO: 1381589 - protein, 9 aa, Homo Sapiens
VTTVNSPGP

SEQ ID NO: 1381590 - protein, 9 aa, Homo Sapiens
VPSYKWLRN

SEQ ID NO: 1381591 - protein, 9 aa, Homo Sapiens
RATTEDLQE

SEQ ID NO: 1381592 - protein, 9 aa, Homo Sapiens
DSLQEWIDM

SEQ ID NO: 1381593 - protein, 9 aa, Homo Sapiens
ARELPLQRQ

SEQ ID NO: 1381594 - protein, 9 aa, Homo Sapiens
NVRTATTNR

SEQ ID NO: 1381595 - protein, 9 aa, Homo Sapiens
GRSANKFVD

SEQ ID NO: 1381596 - protein, 9 aa, Homo Sapiens
RINHIFHER

SEQ ID NO: 1381597 - protein, 9 aa, Homo Sapiens
EVKPFLAAL

SEQ ID NO: 1381598 - protein, 9 aa, Homo Sapiens
QSTTGSQRI

SEQ ID NO: 1381599 - protein, 9 aa, Homo Sapiens
HLGSGYWLV

SEQ ID NO: 1381600 - protein, 9 aa, Homo Sapiens
ILFHYPHFW

SEQ ID NO: 1381601 - protein, 9 aa, Homo Sapiens
RLPAQLPAS

SEQ ID NO: 1381602 - protein, 9 aa, Homo Sapiens
PKTGILMLS

SEQ ID NO: 1381603 - protein, 9 aa, Homo Sapiens
TSQTFPRES

SEQ ID NO: 1381604 - protein, 9 aa, Homo Sapiens
PLLLPAPWT

SEQ ID NO: 1381605 - protein, 9 aa, Homo Sapiens
FSSVVGLVT

SEQ ID NO: 1381606 - protein, 9 aa, Homo Sapiens
FPKDKFVEI

SEQ ID NO: 1381607 - protein, 9 aa, Homo Sapiens
MFNAGDGFS

SEQ ID NO: 1381608 - protein, 9 aa, Homo Sapiens
VLFIFLLVA

SEQ ID NO: 1381609 - protein, 9 aa, Homo Sapiens
AQQARAVVD

SEQ ID NO: 1381610 - protein, 9 aa, Homo Sapiens
GKGKSQLSL

SEQ ID NO: 1381611 - protein, 9 aa, Homo Sapiens
KAKVQDKEG

SEQ ID NO: 1381612 - protein, 9 aa, Homo Sapiens
CPFHDGDYL

SEQ ID NO: 1381613 - protein, 9 aa, Homo Sapiens
ALHESEGSL

SEQ ID NO: 1381614 - protein, 9 aa, Homo Sapiens
NRRELWSLF

SEQ ID NO: 1381615 - protein, 9 aa, Homo Sapiens
AVVMVVRPV

SEQ ID NO: 1381616 - protein, 9 aa, Homo Sapiens
SLQFSLMAK

SEQ ID NO: 1381617 - protein, 9 aa, Homo Sapiens
NAVEMLKFE

SEQ ID NO: 1381618 - protein, 9 aa, Homo Sapiens
NGVINILQP

SEQ ID NO: 1381619 - protein, 9 aa, Homo Sapiens
QQERRDPGH

SEQ ID NO: 1381620 - protein, 9 aa, Homo Sapiens
TNCCLFCFW

SEQ ID NO: 1381621 - protein, 9 aa, Homo Sapiens
QRSTQTVFS

SEQ ID NO: 1381622 - protein, 9 aa, Homo Sapiens
LEIKENDRS

SEQ ID NO: 1381623 - protein, 9 aa, Homo Sapiens
SENARSPPQ

SEQ ID NO: 1381624 - protein, 9 aa, Homo Sapiens
SHPEFEEDG

SEQ ID NO: 1381625 - protein, 9 aa, Homo Sapiens
KVLYPPLRP

SEQ ID NO: 1381626 - protein, 9 aa, Homo Sapiens
WALSLSGGR

SEQ ID NO: 1381627 - protein, 9 aa, Homo Sapiens
HSYLAQSVQ

SEQ ID NO: 1381628 - protein, 9 aa, Homo Sapiens
VSLLNTTKN

SEQ ID NO: 1381629 - protein, 9 aa, Homo Sapiens
NAAVDAVRA

SEQ ID NO: 1381630 - protein, 9 aa, Homo Sapiens
QGQELSAHQ

SEQ ID NO: 1381631 - protein, 9 aa, Homo Sapiens
ARSPPQLLF

SEQ ID NO: 1381632 - protein, 9 aa, Homo Sapiens
CGPVVAGRG

SEQ ID NO: 1381633 - protein, 9 aa, Homo Sapiens
FMCPQGSPS

SEQ ID NO: 1381634 - protein, 9 aa, Homo Sapiens
HKEDTDGHV

SEQ ID NO: 1381635 - protein, 9 aa, Homo Sapiens
TPSLSVGKL

SEQ ID NO: 1381636 - protein, 9 aa, Homo Sapiens
VTTVANFLS

SEQ ID NO: 1381637 - protein, 9 aa, Homo Sapiens
ATRRFSQVL

SEQ ID NO: 1381638 - protein, 9 aa, Homo Sapiens
GATVPLQHH

SEQ ID NO: 1381639 - protein, 9 aa, Homo Sapiens
EEGFDWSDR

SEQ ID NO: 1381640 - protein, 9 aa, Homo Sapiens
GLLWGHLVR

SEQ ID NO: 1381641 - protein, 9 aa, Homo Sapiens
GDFHYKTVD

SEQ ID NO: 1381642 - protein, 9 aa, Homo Sapiens
DGMLENYRN

SEQ ID NO: 1381643 - protein, 9 aa, Homo Sapiens
LHPGLAVPA

SEQ ID NO: 1381644 - protein, 9 aa, Homo Sapiens
CLCHSYCCI

SEQ ID NO: 1381645 - protein, 9 aa, Homo Sapiens
LRGAATRMG

SEQ ID NO: 1381646 - protein, 9 aa, Homo Sapiens
PEQTALHES

SEQ ID NO: 1381647 - protein, 9 aa, Homo Sapiens
VRIKPTQSV

SEQ ID NO: 1381648 - protein, 9 aa, Homo Sapiens
AHQAPSPPA

SEQ ID NO: 1381649 - protein, 9 aa, Homo Sapiens
NIQVRKKQK

SEQ ID NO: 1381650 - protein, 9 aa, Homo Sapiens
KGGVVTILE

SEQ ID NO: 1381651 - protein, 9 aa, Homo Sapiens
NSQPQVHPV

SEQ ID NO: 1381652 - protein, 9 aa, Homo Sapiens
DIEGIDREY

SEQ ID NO: 1381653 - protein, 9 aa, Homo Sapiens
DPGHRQQPT

SEQ ID NO: 1381654 - protein, 9 aa, Homo Sapiens
SPDSLRKHK

SEQ ID NO: 1381655 - protein, 9 aa, Homo Sapiens
PQVPRLPAQ

SEQ ID NO: 1381656 - protein, 9 aa, Homo Sapiens
VAYMLSVTG

SEQ ID NO: 1381657 - protein, 9 aa, Homo Sapiens
SVWSWAGRP

SEQ ID NO: 1381658 - protein, 9 aa, Homo Sapiens
GGVCHRTKV

SEQ ID NO: 1381659 - protein, 9 aa, Homo Sapiens
LPGQKLSIP

SEQ ID NO: 1381660 - protein, 9 aa, Homo Sapiens
PEKCRCEST

SEQ ID NO: 1381661 - protein, 9 aa, Homo Sapiens
HGGRHLPLL

SEQ ID NO: 1381662 - protein, 9 aa, Homo Sapiens
TFNKDTVIV

SEQ ID NO: 1381663 - protein, 9 aa, Homo Sapiens
AQQRHQRNA

SEQ ID NO: 1381664 - protein, 9 aa, Homo Sapiens
KEDIKCVKS

SEQ ID NO: 1381665 - protein, 9 aa, Homo Sapiens
VELLGLDKN

SEQ ID NO: 1381666 - protein, 9 aa, Homo Sapiens
NEALPLFLL

SEQ ID NO: 1381667 - protein, 9 aa, Homo Sapiens
NTPPEGWKL

SEQ ID NO: 1381668 - protein, 9 aa, Homo Sapiens
KKKQEPPCT

SEQ ID NO: 1381669 - protein, 9 aa, Homo Sapiens
KKLSTIALT

SEQ ID NO: 1381670 - protein, 9 aa, Homo Sapiens
ATQQTTASS

SEQ ID NO: 1381671 - protein, 9 aa, Homo Sapiens
AQGRSANKF

SEQ ID NO: 1381672 - protein, 9 aa, Homo Sapiens
LVLLMFNAG

SEQ ID NO: 1381673 - protein, 9 aa, Homo Sapiens
PVQRQREWF

SEQ ID NO: 1381674 - protein, 9 aa, Homo Sapiens
YQLYCLFSQ

SEQ ID NO: 1381675 - protein, 9 aa, Homo Sapiens
MVVRPVATL

SEQ ID NO: 1381676 - protein, 9 aa, Homo Sapiens
KEKSYCQVR

SEQ ID NO: 1381677 - protein, 9 aa, Homo Sapiens
RTKVCAVPD

SEQ ID NO: 1381678 - protein, 9 aa, Homo Sapiens
RGSVHPDKW

SEQ ID NO: 1381679 - protein, 9 aa, Homo Sapiens
SWAHASGPG

SEQ ID NO: 1381680 - protein, 9 aa, Homo Sapiens
ARINHIFHE

SEQ ID NO: 1381681 - protein, 9 aa, Homo Sapiens
GILIKRQQQ

SEQ ID NO: 1381682 - protein, 9 aa, Homo Sapiens
LRCHRHKPW

SEQ ID NO: 1381683 - protein, 9 aa, Homo Sapiens
DSLPNLKEI

SEQ ID NO: 1381684 - protein, 9 aa, Homo Sapiens
TPASGLHSP

SEQ ID NO: 1381685 - protein, 9 aa, Homo Sapiens
QELSAHQAP

SEQ ID NO: 1381686 - protein, 9 aa, Homo Sapiens
LWREQQHPA

SEQ ID NO: 1381687 - protein, 9 aa, Homo Sapiens
VHIVALDRD

SEQ ID NO: 1381688 - protein, 9 aa, Homo Sapiens
DEEQERRDI

SEQ ID NO: 1381689 - protein, 9 aa, Homo Sapiens
FSQAVGRQL

SEQ ID NO: 1381690 - protein, 9 aa, Homo Sapiens
IQGQELSAH

SEQ ID NO: 1381691 - protein, 9 aa, Homo Sapiens
PAQLPASPL

SEQ ID NO: 1381692 - protein, 9 aa, Homo Sapiens
DILETSWGL

SEQ ID NO: 1381693 - protein, 9 aa, Homo Sapiens
QYKWPQWLH

SEQ ID NO: 1381694 - protein, 9 aa, Homo Sapiens
LQAVYLLVQ

SEQ ID NO: 1381695 - protein, 9 aa, Homo Sapiens
AYVAPEVLR

SEQ ID NO: 1381696 - protein, 9 aa, Homo Sapiens
SYTIVLKAV

SEQ ID NO: 1381697 - protein, 9 aa, Homo Sapiens
PKKKKEAYS

SEQ ID NO: 1381698 - protein, 9 aa, Homo Sapiens
HLEFLGAAA

SEQ ID NO: 1381699 - protein, 9 aa, Homo Sapiens
TSCVAAGRG

SEQ ID NO: 1381700 - protein, 9 aa, Homo Sapiens
AQSVQSHSA

SEQ ID NO: 1381701 - protein, 9 aa, Homo Sapiens
GSSQNSCSC

SEQ ID NO: 1381702 - protein, 9 aa, Homo Sapiens
INGKFQLPG

SEQ ID NO: 1381703 - protein, 9 aa, Homo Sapiens
WVERRQFNR

SEQ ID NO: 1381704 - protein, 9 aa, Homo Sapiens
EDIKCVKSL

SEQ ID NO: 1381705 - protein, 9 aa, Homo Sapiens
VRLIELAES

SEQ ID NO: 1381706 - protein, 9 aa, Homo Sapiens
VMMAAVKTC

SEQ ID NO: 1381707 - protein, 9 aa, Homo Sapiens
VQGQQERRD

SEQ ID NO: 1381708 - protein, 9 aa, Homo Sapiens
RPCGRPRGS

SEQ ID NO: 1381709 - protein, 9 aa, Homo Sapiens
PSSSHMGAP

SEQ ID NO: 1381710 - protein, 9 aa, Homo Sapiens
EVSEIFELS

SEQ ID NO: 1381711 - protein, 9 aa, Homo Sapiens
LTEQMKCLE

SEQ ID NO: 1381712 - protein, 9 aa, Homo Sapiens
LFEHCSEVS

SEQ ID NO: 1381713 - protein, 9 aa, Homo Sapiens
TALHESEGS

SEQ ID NO: 1381714 - protein, 9 aa, Homo Sapiens
NHTLTQHSS

SEQ ID NO: 1381715 - protein, 9 aa, Homo Sapiens
PDSLALHLQ

SEQ ID NO: 1381716 - protein, 9 aa, Homo Sapiens
FQACSPSYT

SEQ ID NO: 1381717 - protein, 9 aa, Homo Sapiens
WRPLRKTAP

SEQ ID NO: 1381718 - protein, 9 aa, Homo Sapiens
NRMPKDVNI

SEQ ID NO: 1381719 - protein, 9 aa, Homo Sapiens
PSVWSWAGR

SEQ ID NO: 1381720 - protein, 9 aa, Homo Sapiens
IRYVALKLK

SEQ ID NO: 1381721 - protein, 9 aa, Homo Sapiens
ASWSPASGS

SEQ ID NO: 1381722 - protein, 9 aa, Homo Sapiens
HRKASVVVA

SEQ ID NO: 1381723 - protein, 9 aa, Homo Sapiens
CASDHVKVV

SEQ ID NO: 1381724 - protein, 9 aa, Homo Sapiens
EQTALHESE

SEQ ID NO: 1381725 - protein, 9 aa, Homo Sapiens
VRGRARGSK

SEQ ID NO: 1381726 - protein, 9 aa, Homo Sapiens
TGSVRKANR

SEQ ID NO: 1381727 - protein, 9 aa, Homo Sapiens
SEIRIHPPE

SEQ ID NO: 1381728 - protein, 9 aa, Homo Sapiens
FITWRKSAE

SEQ ID NO: 1381729 - protein, 9 aa, Homo Sapiens
SHRGVPLVA

SEQ ID NO: 1381730 - protein, 9 aa, Homo Sapiens
RKACSTRTV

SEQ ID NO: 1381731 - protein, 9 aa, Homo Sapiens
GEVRLIELA

SEQ ID NO: 1381732 - protein, 9 aa, Homo Sapiens
KSPKQATQP

SEQ ID NO: 1381733 - protein, 9 aa, Homo Sapiens
SRSRYTQEN

SEQ ID NO: 1381734 - protein, 9 aa, Homo Sapiens
ERERDFTPS

SEQ ID NO: 1381735 - protein, 9 aa, Homo Sapiens
KNVFKEASS

SEQ ID NO: 1381736 - protein, 9 aa, Homo Sapiens
YPRECKLGA

SEQ ID NO: 1381737 - protein, 9 aa, Homo Sapiens
IALFTSALL

SEQ ID NO: 1381738 - protein, 9 aa, Homo Sapiens
LQHHVWTPA

SEQ ID NO: 1381739 - protein, 9 aa, Homo Sapiens
RRIRDEKGE

SEQ ID NO: 1381740 - protein, 9 aa, Homo Sapiens
LIGNILEES

SEQ ID NO: 1381741 - protein, 9 aa, Homo Sapiens
QVHPVPGNP

SEQ ID NO: 1381742 - protein, 9 aa, Homo Sapiens
ISSAALPLN

SEQ ID NO: 1381743 - protein, 9 aa, Homo Sapiens
ESTKRRKKQ

SEQ ID NO: 1381744 - protein, 9 aa, Homo Sapiens
VASTPDNQG

SEQ ID NO: 1381745 - protein, 9 aa, Homo Sapiens
IHPELRKKL

SEQ ID NO: 1381746 - protein, 9 aa, Homo Sapiens
KANRMPKDV

SEQ ID NO: 1381747 - protein, 9 aa, Homo Sapiens
TDRGGARAG

SEQ ID NO: 1381748 - protein, 9 aa, Homo Sapiens
VFVQVKRGP

SEQ ID NO: 1381749 - protein, 9 aa, Homo Sapiens
IGSYTIVLK

SEQ ID NO: 1381750 - protein, 9 aa, Homo Sapiens
THVDEDLKA

SEQ ID NO: 1381751 - protein, 9 aa, Homo Sapiens
KQYDAYGPA

SEQ ID NO: 1381752 - protein, 9 aa, Homo Sapiens
WRLLKALKT

SEQ ID NO: 1381753 - protein, 9 aa, Homo Sapiens
EMIRPSVYS

SEQ ID NO: 1381754 - protein, 9 aa, Homo Sapiens
NGLPATPIT

SEQ ID NO: 1381755 - protein, 9 aa, Homo Sapiens
NVWSLPAEP

SEQ ID NO: 1381756 - protein, 9 aa, Homo Sapiens
STCVAYAAT

SEQ ID NO: 1381757 - protein, 9 aa, Homo Sapiens
FKCSSALNT

SEQ ID NO: 1381758 - protein, 9 aa, Homo Sapiens
SSIFFELEA

SEQ ID NO: 1381759 - protein, 9 aa, Homo Sapiens
SSHQSAPPI

SEQ ID NO: 1381760 - protein, 9 aa, Homo Sapiens
TLRKKTCLP

SEQ ID NO: 1381761 - protein, 9 aa, Homo Sapiens
GPDNSESVT

SEQ ID NO: 1381762 - protein, 9 aa, Homo Sapiens
PPCTRLHGN

SEQ ID NO: 1381763 - protein, 9 aa, Homo Sapiens
TSPRGKPVG

SEQ ID NO: 1381764 - protein, 9 aa, Homo Sapiens
FTDPQLHRI

SEQ ID NO: 1381765 - protein, 9 aa, Homo Sapiens
TFITSSYHS

SEQ ID NO: 1381766 - protein, 9 aa, Homo Sapiens
YQERQLFEF

SEQ ID NO: 1381767 - protein, 9 aa, Homo Sapiens
TVLENPRNG

SEQ ID NO: 1381768 - protein, 9 aa, Homo Sapiens
RHHQTFAGK

SEQ ID NO: 1381769 - protein, 9 aa, Homo Sapiens
KMQWDHCTS

SEQ ID NO: 1381770 - protein, 9 aa, Homo Sapiens
VWSWAGRPW

SEQ ID NO: 1381771 - protein, 9 aa, Homo Sapiens
VGGSHQEQP

SEQ ID NO: 1381772 - protein, 9 aa, Homo Sapiens
HFVCVLGRI

SEQ ID NO: 1381773 - protein, 9 aa, Homo Sapiens
LVQYKWPQW

SEQ ID NO: 1381774 - protein, 9 aa, Homo Sapiens
CTIRYVALK

SEQ ID NO: 1381775 - protein, 9 aa, Homo Sapiens
TEAGESSHK

SEQ ID NO: 1381776 - protein, 9 aa, Homo Sapiens
HAHYNAHAP

SEQ ID NO: 1381777 - protein, 9 aa, Homo Sapiens
LYGKRSQTV

SEQ ID NO: 1381778 - protein, 9 aa, Homo Sapiens
GEKGIMVSA

SEQ ID NO: 1381779 - protein, 9 aa, Homo Sapiens
HPGLAVPAR

SEQ ID NO: 1381780 - protein, 9 aa, Homo Sapiens
CPEGPHRPS

SEQ ID NO: 1381781 - protein, 9 aa, Homo Sapiens
RAAEEEDGA

SEQ ID NO: 1381782 - protein, 9 aa, Homo Sapiens
ALGVVLARE

SEQ ID NO: 1381783 - protein, 9 aa, Homo Sapiens
IEPVGNREK

SEQ ID NO: 1381784 - protein, 9 aa, Homo Sapiens
PYQDPDGEN

SEQ ID NO: 1381785 - protein, 9 aa, Homo Sapiens
DPALLVPHA

SEQ ID NO: 1381786 - protein, 9 aa, Homo Sapiens
EIRIHPPEP

SEQ ID NO: 1381787 - protein, 9 aa, Homo Sapiens
ASKRFCAER

SEQ ID NO: 1381788 - protein, 9 aa, Homo Sapiens
QPQVHPVPG

SEQ ID NO: 1381789 - protein, 9 aa, Homo Sapiens
EDYSRLYQL

SEQ ID NO: 1381790 - protein, 9 aa, Homo Sapiens
SKYNEDFER

SEQ ID NO: 1381791 - protein, 9 aa, Homo Sapiens
VNPDDRLTC

SEQ ID NO: 1381792 - protein, 9 aa, Homo Sapiens
LATSSPTRR

SEQ ID NO: 1381793 - protein, 9 aa, Homo Sapiens
WREQQHPAG

SEQ ID NO: 1381794 - protein, 9 aa, Homo Sapiens
HVVRLCRAR

SEQ ID NO: 1381795 - protein, 9 aa, Homo Sapiens
HRELQRPQL

SEQ ID NO: 1381796 - protein, 9 aa, Homo Sapiens
ERIKTPPKC

SEQ ID NO: 1381797 - protein, 9 aa, Homo Sapiens
ALALEIPSG

SEQ ID NO: 1381798 - protein, 9 aa, Homo Sapiens
RRPRHGHHP

SEQ ID NO: 1381799 - protein, 9 aa, Homo Sapiens
QENSSTPKR

SEQ ID NO: 1381800 - protein, 9 aa, Homo Sapiens
PGDGATVPL

SEQ ID NO: 1381801 - protein, 9 aa, Homo Sapiens
SRVELLLGH

SEQ ID NO: 1381802 - protein, 9 aa, Homo Sapiens
EEKKTGSVR

SEQ ID NO: 1381803 - protein, 9 aa, Homo Sapiens
PIVPFPVRR

SEQ ID NO: 1381804 - protein, 9 aa, Homo Sapiens
ITPTPQVPR

SEQ ID NO: 1381805 - protein, 9 aa, Homo Sapiens
QERNVRTAT

SEQ ID NO: 1381806 - protein, 9 aa, Homo Sapiens
APRFSSVVG

SEQ ID NO: 1381807 - protein, 9 aa, Homo Sapiens
VECQLGHPA

SEQ ID NO: 1381808 - protein, 9 aa, Homo Sapiens
LASKRFCAE

SEQ ID NO: 1381809 - protein, 9 aa, Homo Sapiens
CGTWTCSAP

SEQ ID NO: 1381810 - protein, 9 aa, Homo Sapiens
VVFVQVKRG

SEQ ID NO: 1381811 - protein, 9 aa, Homo Sapiens
VLYLKKKQE

SEQ ID NO: 1381812 - protein, 9 aa, Homo Sapiens
QLWHRELQR

SEQ ID NO: 1381813 - protein, 9 aa, Homo Sapiens
GWAASPAAD

SEQ ID NO: 1381814 - protein, 9 aa, Homo Sapiens
RMIVTPPEQ

SEQ ID NO: 1381815 - protein, 9 aa, Homo Sapiens
ERIPKPQVI

SEQ ID NO: 1381816 - protein, 9 aa, Homo Sapiens
NSESVTTVA

SEQ ID NO: 1381817 - protein, 9 aa, Homo Sapiens
WQGWALSLS

SEQ ID NO: 1381818 - protein, 9 aa, Homo Sapiens
LRKKLRKRL

SEQ ID NO: 1381819 - protein, 9 aa, Homo Sapiens
MSATLPINP

SEQ ID NO: 1381820 - protein, 9 aa, Homo Sapiens
RGGGCLPPE

SEQ ID NO: 1381821 - protein, 9 aa, Homo Sapiens
TEEEALEIK

SEQ ID NO: 1381822 - protein, 9 aa, Homo Sapiens
GDLEEMRKV

SEQ ID NO: 1381823 - protein, 9 aa, Homo Sapiens
GVDGEIVYA

SEQ ID NO: 1381824 - protein, 9 aa, Homo Sapiens
INILQPVLA

SEQ ID NO: 1381825 - protein, 9 aa, Homo Sapiens
TKLAKKNRN

SEQ ID NO: 1381826 - protein, 9 aa, Homo Sapiens
KVCTIRYVA

SEQ ID NO: 1381827 - protein, 9 aa, Homo Sapiens
LQQPLRRGP

SEQ ID NO: 1381828 - protein, 9 aa, Homo Sapiens
FVPQRPQTD

SEQ ID NO: 1381829 - protein, 9 aa, Homo Sapiens
VPSNPPRHP

SEQ ID NO: 1381830 - protein, 9 aa, Homo Sapiens
PMREVAEAA

SEQ ID NO: 1381831 - protein, 9 aa, Homo Sapiens
CISLSETRN

SEQ ID NO: 1381832 - protein, 9 aa, Homo Sapiens
PKDKFVEIG

SEQ ID NO: 1381833 - protein, 9 aa, Homo Sapiens
QQHPAGTRT

SEQ ID NO: 1381834 - protein, 9 aa, Homo Sapiens
SEVSEIFEL

SEQ ID NO: 1381835 - protein, 9 aa, Homo Sapiens
PNCIPHKLY

SEQ ID NO: 1381836 - protein, 9 aa, Homo Sapiens
TLYSPEQTA

SEQ ID NO: 1381837 - protein, 9 aa, Homo Sapiens
RGAVLQHGD

SEQ ID NO: 1381838 - protein, 9 aa, Homo Sapiens
AAWTGASPN

SEQ ID NO: 1381839 - protein, 9 aa, Homo Sapiens
QAQQRHQRN

SEQ ID NO: 1381840 - protein, 9 aa, Homo Sapiens
FETCSHIKE

SEQ ID NO: 1381841 - protein, 9 aa, Homo Sapiens
KWTCTVSRY

SEQ ID NO: 1381842 - protein, 9 aa, Homo Sapiens
KTGSNEVTT

SEQ ID NO: 1381843 - protein, 9 aa, Homo Sapiens
RIHPPEPGL

SEQ ID NO: 1381844 - protein, 9 aa, Homo Sapiens
NMKKRIPQD

SEQ ID NO: 1381845 - protein, 9 aa, Homo Sapiens
LLRSEKSSY

SEQ ID NO: 1381846 - protein, 9 aa, Homo Sapiens
PEQSACHGY

SEQ ID NO: 1381847 - protein, 9 aa, Homo Sapiens
SPGEARAPL

SEQ ID NO: 1381848 - protein, 9 aa, Homo Sapiens
LIKAFHEDY

SEQ ID NO: 1381849 - protein, 9 aa, Homo Sapiens
VYVAQSAGR

SEQ ID NO: 1381850 - protein, 9 aa, Homo Sapiens
AWPEPGRVG

SEQ ID NO: 1381851 - protein, 9 aa, Homo Sapiens
LRQISGRHL

SEQ ID NO: 1381852 - protein, 9 aa, Homo Sapiens
PCCMKTGLR

SEQ ID NO: 1381853 - protein, 9 aa, Homo Sapiens
YHEKILIGT

SEQ ID NO: 1381854 - protein, 9 aa, Homo Sapiens
KWTWEGCTW

SEQ ID NO: 1381855 - protein, 9 aa, Homo Sapiens
AQLFTTRKE

SEQ ID NO: 1381856 - protein, 9 aa, Homo Sapiens
SKRFCAERQ

SEQ ID NO: 1381857 - protein, 9 aa, Homo Sapiens
KKYYQKCDW

SEQ ID NO: 1381858 - protein, 9 aa, Homo Sapiens
CMKTGLRCG

SEQ ID NO: 1381859 - protein, 9 aa, Homo Sapiens
LPAREGSLW

SEQ ID NO: 1381860 - protein, 9 aa, Homo Sapiens
PLRGAATRM

SEQ ID NO: 1381861 - protein, 9 aa, Homo Sapiens
IRTQGLECR

SEQ ID NO: 1381862 - protein, 9 aa, Homo Sapiens
REVVGEGLI

SEQ ID NO: 1381863 - protein, 9 aa, Homo Sapiens
ASWAHASGP

SEQ ID NO: 1381864 - protein, 9 aa, Homo Sapiens
KGIMVSAGD

SEQ ID NO: 1381865 - protein, 9 aa, Homo Sapiens
LTGWAASPA

SEQ ID NO: 1381866 - protein, 9 aa, Homo Sapiens
LSGPRMLWG

SEQ ID NO: 1381867 - protein, 9 aa, Homo Sapiens
WFKVVTSVK

SEQ ID NO: 1381868 - protein, 9 aa, Homo Sapiens
VAEYIDSNH

SEQ ID NO: 1381869 - protein, 9 aa, Homo Sapiens
LYSPEQTAL

SEQ ID NO: 1381870 - protein, 9 aa, Homo Sapiens
PKEGQEVGL

SEQ ID NO: 1381871 - protein, 9 aa, Homo Sapiens
AWRKMQWDH

SEQ ID NO: 1381872 - protein, 9 aa, Homo Sapiens
FERAWREDL

SEQ ID NO: 1381873 - protein, 9 aa, Homo Sapiens
NREKILNRE

SEQ ID NO: 1381874 - protein, 9 aa, Homo Sapiens
PAGFDPGAS

SEQ ID NO: 1381875 - protein, 9 aa, Homo Sapiens
WCPFIPRRA

SEQ ID NO: 1381876 - protein, 9 aa, Homo Sapiens
VWNCPSKKT

SEQ ID NO: 1381877 - protein, 9 aa, Homo Sapiens
LEFLGAAAA

SEQ ID NO: 1381878 - protein, 9 aa, Homo Sapiens
PPQLKELYQ

SEQ ID NO: 1381879 - protein, 9 aa, Homo Sapiens
KCKCCDYET

SEQ ID NO: 1381880 - protein, 9 aa, Homo Sapiens
TCQIMVMMW

SEQ ID NO: 1381881 - protein, 9 aa, Homo Sapiens
CRENVCLNY

SEQ ID NO: 1381882 - protein, 9 aa, Homo Sapiens
LLVQYIIMV

SEQ ID NO: 1381883 - protein, 9 aa, Homo Sapiens
VANLAISLT

SEQ ID NO: 1381884 - protein, 9 aa, Homo Sapiens
RTFVVFVQV

SEQ ID NO: 1381885 - protein, 9 aa, Homo Sapiens
AENLLLGAN

SEQ ID NO: 1381886 - protein, 9 aa, Homo Sapiens
FVCTLHPSG

SEQ ID NO: 1381887 - protein, 9 aa, Homo Sapiens
RGGARAGAF

SEQ ID NO: 1381888 - protein, 9 aa, Homo Sapiens
HHVWTPADQ

SEQ ID NO: 1381889 - protein, 9 aa, Homo Sapiens
WAHASGPGP

SEQ ID NO: 1381890 - protein, 9 aa, Homo Sapiens
PGLWMLARS

SEQ ID NO: 1381891 - protein, 9 aa, Homo Sapiens
LLLGANLNI

SEQ ID NO: 1381892 - protein, 9 aa, Homo Sapiens
DIQVPSNPP

SEQ ID NO: 1381893 - protein, 9 aa, Homo Sapiens
AVPDTAWLQ

SEQ ID NO: 1381894 - protein, 9 aa, Homo Sapiens
LTRDMAQAK

SEQ ID NO: 1381895 - protein, 9 aa, Homo Sapiens
HPKEGQEVG

SEQ ID NO: 1381896 - protein, 9 aa, Homo Sapiens
SLRCHRHKP

SEQ ID NO: 1381897 - protein, 9 aa, Homo Sapiens
ALLVPHACC

SEQ ID NO: 1381898 - protein, 9 aa, Homo Sapiens
QQDYGSAQG

SEQ ID NO: 1381899 - protein, 9 aa, Homo Sapiens
YKWPQWLHQ

SEQ ID NO: 1381900 - protein, 9 aa, Homo Sapiens
KVSQDHHNN

SEQ ID NO: 1381901 - protein, 9 aa, Homo Sapiens
PTEGRIQMV

SEQ ID NO: 1381902 - protein, 9 aa, Homo Sapiens
EKSYCQVRL

SEQ ID NO: 1381903 - protein, 9 aa, Homo Sapiens
ILQPVLADH

SEQ ID NO: 1381904 - protein, 9 aa, Homo Sapiens
QEWIDMTGF

SEQ ID NO: 1381905 - protein, 9 aa, Homo Sapiens
SPTLTKHKR

SEQ ID NO: 1381906 - protein, 9 aa, Homo Sapiens
PPSSSHMGA

SEQ ID NO: 1381907 - protein, 9 aa, Homo Sapiens
CTVSRYKIW

SEQ ID NO: 1381908 - protein, 9 aa, Homo Sapiens
GLNEALPLF

SEQ ID NO: 1381909 - protein, 9 aa, Homo Sapiens
EHTETDAVD

SEQ ID NO: 1381910 - protein, 9 aa, Homo Sapiens
SELSFPLGV

SEQ ID NO: 1381911 - protein, 9 aa, Homo Sapiens
VPDTAWLQL

SEQ ID NO: 1381912 - protein, 9 aa, Homo Sapiens
HHSLPAREG

SEQ ID NO: 1381913 - protein, 9 aa, Homo Sapiens
MPSAQGGRA

SEQ ID NO: 1381914 - protein, 9 aa, Homo Sapiens
PGKEGSSAS

SEQ ID NO: 1381915 - protein, 9 aa, Homo Sapiens
EKEEEEEGF

SEQ ID NO: 1381916 - protein, 9 aa, Homo Sapiens
PQLQLVTSR

SEQ ID NO: 1381917 - protein, 9 aa, Homo Sapiens
MPKDVNIQV

SEQ ID NO: 1381918 - protein, 9 aa, Homo Sapiens
QSVQSHSAV

SEQ ID NO: 1381919 - protein, 9 aa, Homo Sapiens
LSQFPLNST

SEQ ID NO: 1381920 - protein, 9 aa, Homo Sapiens
LAGGASWAH

SEQ ID NO: 1381921 - protein, 9 aa, Homo Sapiens
KKQKHETRR

SEQ ID NO: 1381922 - protein, 9 aa, Homo Sapiens
VRPLWDKIA

SEQ ID NO: 1381923 - protein, 9 aa, Homo Sapiens
ACASDHVKV

SEQ ID NO: 1381924 - protein, 9 aa, Homo Sapiens
SYPGQQQDY

SEQ ID NO: 1381925 - protein, 9 aa, Homo Sapiens
RGHHEYTES

SEQ ID NO: 1381926 - protein, 9 aa, Homo Sapiens
SEDEQSNHT

SEQ ID NO: 1381927 - protein, 9 aa, Homo Sapiens
SGSGLGPQR

SEQ ID NO: 1381928 - protein, 9 aa, Homo Sapiens
LSCRNVWSL

SEQ ID NO: 1381929 - protein, 9 aa, Homo Sapiens
QFRHVIWKG

SEQ ID NO: 1381930 - protein, 9 aa, Homo Sapiens
RARGSKDFS

SEQ ID NO: 1381931 - protein, 9 aa, Homo Sapiens
SVQSHSAVH

SEQ ID NO: 1381932 - protein, 9 aa, Homo Sapiens
VGRQLGPQQ

SEQ ID NO: 1381933 - protein, 9 aa, Homo Sapiens
TMARRLAYL

SEQ ID NO: 1381934 - protein, 9 aa, Homo Sapiens
VATLSPGEA

SEQ ID NO: 1381935 - protein, 9 aa, Homo Sapiens
ARAVVDIVK

SEQ ID NO: 1381936 - protein, 9 aa, Homo Sapiens
LLRDPNTPV

SEQ ID NO: 1381937 - protein, 9 aa, Homo Sapiens
KKKTGSNEV

SEQ ID NO: 1381938 - protein, 9 aa, Homo Sapiens
TDAVDPRSN

SEQ ID NO: 1381939 - protein, 9 aa, Homo Sapiens
LDGENRRIP

SEQ ID NO: 1381940 - protein, 9 aa, Homo Sapiens
PPKGSPPPS

SEQ ID NO: 1381941 - protein, 9 aa, Homo Sapiens
YFSQAVGRQ

SEQ ID NO: 1381942 - protein, 9 aa, Homo Sapiens
GANLNIKIA

SEQ ID NO: 1381943 - protein, 9 aa, Homo Sapiens
SVVGLVTIV

SEQ ID NO: 1381944 - protein, 9 aa, Homo Sapiens
IHFFLIEKN

SEQ ID NO: 1381945 - protein, 9 aa, Homo Sapiens
GLGWTELAR

SEQ ID NO: 1381946 - protein, 9 aa, Homo Sapiens
IGCAKQTKQ

SEQ ID NO: 1381947 - protein, 9 aa, Homo Sapiens
WPTEGRIQM

SEQ ID NO: 1381948 - protein, 9 aa, Homo Sapiens
NRRIPINTD

SEQ ID NO: 1381949 - protein, 9 aa, Homo Sapiens
LNTTKNFSC

SEQ ID NO: 1381950 - protein, 9 aa, Homo Sapiens
KKLQKKKNK

SEQ ID NO: 1381951 - protein, 9 aa, Homo Sapiens
QCLLRHAWP

SEQ ID NO: 1381952 - protein, 9 aa, Homo Sapiens
HIAETMARR

SEQ ID NO: 1381953 - protein, 9 aa, Homo Sapiens
SSPPSRSAA

SEQ ID NO: 1381954 - protein, 9 aa, Homo Sapiens
KAQWGGESS

SEQ ID NO: 1381955 - protein, 9 aa, Homo Sapiens
LASEFHAEK

SEQ ID NO: 1381956 - protein, 9 aa, Homo Sapiens
SGVAAVTFE

SEQ ID NO: 1381957 - protein, 9 aa, Homo Sapiens
RLRHLLCHG

SEQ ID NO: 1381958 - protein, 9 aa, Homo Sapiens
SVGSDTTDL

SEQ ID NO: 1381959 - protein, 9 aa, Homo Sapiens
KLLGRGPAA

SEQ ID NO: 1381960 - protein, 9 aa, Homo Sapiens
NHHHSEYQQ

SEQ ID NO: 1381961 - protein, 9 aa, Homo Sapiens
NFTDPQLHR

SEQ ID NO: 1381962 - protein, 9 aa, Homo Sapiens
HFFLIEKNL

SEQ ID NO: 1381963 - protein, 9 aa, Homo Sapiens
QVANLAISL

SEQ ID NO: 1381964 - protein, 9 aa, Homo Sapiens
AWREDLTIK

SEQ ID NO: 1381965 - protein, 9 aa, Homo Sapiens
TYDNYMTET

SEQ ID NO: 1381966 - protein, 9 aa, Homo Sapiens
DISVVVTYF

SEQ ID NO: 1381967 - protein, 9 aa, Homo Sapiens
AVHGGVCHR

SEQ ID NO: 1381968 - protein, 9 aa, Homo Sapiens
AEKEDIKCV

SEQ ID NO: 1381969 - protein, 9 aa, Homo Sapiens
VIDVQGKKI

SEQ ID NO: 1381970 - protein, 9 aa, Homo Sapiens
RHLPLLTWQ

SEQ ID NO: 1381971 - protein, 9 aa, Homo Sapiens
HYNAHAPPH

SEQ ID NO: 1381972 - protein, 9 aa, Homo Sapiens
GPKEDAGDP

SEQ ID NO: 1381973 - protein, 9 aa, Homo Sapiens
VQLLNYVIS

SEQ ID NO: 1381974 - protein, 9 aa, Homo Sapiens
CEDAQAIQN

SEQ ID NO: 1381975 - protein, 9 aa, Homo Sapiens
PRLPAQLPA

SEQ ID NO: 1381976 - protein, 9 aa, Homo Sapiens
NHGSLRQIS

SEQ ID NO: 1381977 - protein, 9 aa, Homo Sapiens
VQDKEGIPS

SEQ ID NO: 1381978 - protein, 9 aa, Homo Sapiens
LFHYPHFWK

SEQ ID NO: 1381979 - protein, 9 aa, Homo Sapiens
HHLEALQLG

SEQ ID NO: 1381980 - protein, 9 aa, Homo Sapiens
QVRKKQKHE

SEQ ID NO: 1381981 - protein, 9 aa, Homo Sapiens
MIVTPPEQS

SEQ ID NO: 1381982 - protein, 9 aa, Homo Sapiens
RAEEPVEGA

SEQ ID NO: 1381983 - protein, 9 aa, Homo Sapiens
LQLTPPKWL

SEQ ID NO: 1381984 - protein, 9 aa, Homo Sapiens
GAWPEPGRV

SEQ ID NO: 1381985 - protein, 9 aa, Homo Sapiens
REQQHPAGT

SEQ ID NO: 1381986 - protein, 9 aa, Homo Sapiens
WKSATNPPQ

SEQ ID NO: 1381987 - protein, 9 aa, Homo Sapiens
GKEGSSASR

SEQ ID NO: 1381988 - protein, 9 aa, Homo Sapiens
QWPCCMKTG

SEQ ID NO: 1381989 - protein, 9 aa, Homo Sapiens
HERIRLGLK

SEQ ID NO: 1381990 - protein, 9 aa, Homo Sapiens
GRPCGRPRG

SEQ ID NO: 1381991 - protein, 9 aa, Homo Sapiens
LARESLGTA

SEQ ID NO: 1381992 - protein, 9 aa, Homo Sapiens
ERERMEQQR

SEQ ID NO: 1381993 - protein, 9 aa, Homo Sapiens
FCAERQDNK

SEQ ID NO: 1381994 - protein, 9 aa, Homo Sapiens
NDIEGIDRE

SEQ ID NO: 1381995 - protein, 9 aa, Homo Sapiens
DFLKTRVSL

SEQ ID NO: 1381996 - protein, 9 aa, Homo Sapiens
TGVGAVPLT

SEQ ID NO: 1381997 - protein, 9 aa, Homo Sapiens
APRPANYSP

SEQ ID NO: 1381998 - protein, 9 aa, Homo Sapiens
QASPPAARR

SEQ ID NO: 1381999 - protein, 9 aa, Homo Sapiens
DHVKVVTLL

SEQ ID NO: 1382000 - protein, 9 aa, Homo Sapiens
AITLCSSLL

SEQ ID NO: 1382001 - protein, 9 aa, Homo Sapiens
KGFDLCVVC

SEQ ID NO: 1382002 - protein, 9 aa, Homo Sapiens
PVVRNLAAL

SEQ ID NO: 1382003 - protein, 9 aa, Homo Sapiens
TSVKEMDEE

SEQ ID NO: 1382004 - protein, 9 aa, Homo Sapiens
LLFSSLEDP

SEQ ID NO: 1382005 - protein, 9 aa, Homo Sapiens
EWLSGLLDA

SEQ ID NO: 1382006 - protein, 9 aa, Homo Sapiens
TRAYKVCTI

SEQ ID NO: 1382007 - protein, 9 aa, Homo Sapiens
SSQSDPETK

SEQ ID NO: 1382008 - protein, 9 aa, Homo Sapiens
PPRQAQCLL

SEQ ID NO: 1382009 - protein, 9 aa, Homo Sapiens
ASEFHAEKL

SEQ ID NO: 1382010 - protein, 9 aa, Homo Sapiens
EVVNPDSKG

SEQ ID NO: 1382011 - protein, 9 aa, Homo Sapiens
TFLASKDEG

SEQ ID NO: 1382012 - protein, 9 aa, Homo Sapiens
VNSPGPLEE

SEQ ID NO: 1382013 - protein, 9 aa, Homo Sapiens
DRTNHQVHS

SEQ ID NO: 1382014 - protein, 9 aa, Homo Sapiens
MADMVYVAQ

SEQ ID NO: 1382015 - protein, 9 aa, Homo Sapiens
LNEKEEEEE

SEQ ID NO: 1382016 - protein, 9 aa, Homo Sapiens
KKREKRQAV

SEQ ID NO: 1382017 - protein, 9 aa, Homo Sapiens
GCAKQTKQM

SEQ ID NO: 1382018 - protein, 9 aa, Homo Sapiens
KGRGRGRPC

SEQ ID NO: 1382019 - protein, 9 aa, Homo Sapiens
IRIHPPEPG

SEQ ID NO: 1382020 - protein, 9 aa, Homo Sapiens
TVTCQIMVM

SEQ ID NO: 1382021 - protein, 9 aa, Homo Sapiens
NSTWGCPFH

SEQ ID NO: 1382022 - protein, 9 aa, Homo Sapiens
IVTPPEQSA

SEQ ID NO: 1382023 - protein, 9 aa, Homo Sapiens
GPRRGWGTG

SEQ ID NO: 1382024 - protein, 9 aa, Homo Sapiens
SYTKILQQQ

SEQ ID NO: 1382025 - protein, 9 aa, Homo Sapiens
RTCYHPTIV

SEQ ID NO: 1382026 - protein, 9 aa, Homo Sapiens
EKGSVSTII

SEQ ID NO: 1382027 - protein, 9 aa, Homo Sapiens
KQKKLERER

SEQ ID NO: 1382028 - protein, 9 aa, Homo Sapiens
DAQQARAVV

SEQ ID NO: 1382029 - protein, 9 aa, Homo Sapiens
TVHLGSGYW

SEQ ID NO: 1382030 - protein, 9 aa, Homo Sapiens
IVELLGLDK

SEQ ID NO: 1382031 - protein, 9 aa, Homo Sapiens
CERIPKPQV

SEQ ID NO: 1382032 - protein, 9 aa, Homo Sapiens
KQKKREKRQ

SEQ ID NO: 1382033 - protein, 9 aa, Homo Sapiens
CSNLSVKNV

SEQ ID NO: 1382034 - protein, 9 aa, Homo Sapiens
RNSIFNCSI

SEQ ID NO: 1382035 - protein, 9 aa, Homo Sapiens
NIAHIKAKG

SEQ ID NO: 1382036 - protein, 9 aa, Homo Sapiens
TGSQRKEEL

SEQ ID NO: 1382037 - protein, 9 aa, Homo Sapiens
LCCCCRCCC

SEQ ID NO: 1382038 - protein, 9 aa, Homo Sapiens
NQLRNHYII

SEQ ID NO: 1382039 - protein, 9 aa, Homo Sapiens
PEAITLCSS

SEQ ID NO: 1382040 - protein, 9 aa, Homo Sapiens
VPGKEGSSA

SEQ ID NO: 1382041 - protein, 9 aa, Homo Sapiens
VKMTPTEEE

SEQ ID NO: 1382042 - protein, 9 aa, Homo Sapiens
PCGRPRGSK

SEQ ID NO: 1382043 - protein, 9 aa, Homo Sapiens
FGQFWGGLS

SEQ ID NO: 1382044 - protein, 9 aa, Homo Sapiens
AFIWSPTLT

SEQ ID NO: 1382045 - protein, 9 aa, Homo Sapiens
LTVSSLRCH

SEQ ID NO: 1382046 - protein, 9 aa, Homo Sapiens
PQRPQTDEE

SEQ ID NO: 1382047 - protein, 9 aa, Homo Sapiens
NLLEELSLN

SEQ ID NO: 1382048 - protein, 9 aa, Homo Sapiens
ILQQPLRRG

SEQ ID NO: 1382049 - protein, 9 aa, Homo Sapiens
LMADMVYVA

SEQ ID NO: 1382050 - protein, 9 aa, Homo Sapiens
LWFKVVTSV

SEQ ID NO: 1382051 - protein, 9 aa, Homo Sapiens
YVPSLMARL

SEQ ID NO: 1382052 - protein, 9 aa, Homo Sapiens
IAETMARRL

SEQ ID NO: 1382053 - protein, 9 aa, Homo Sapiens
CKWMDSLLS

SEQ ID NO: 1382054 - protein, 9 aa, Homo Sapiens
FGPGTDFVA

SEQ ID NO: 1382055 - protein, 9 aa, Homo Sapiens
VWHYCTLTI

SEQ ID NO: 1382056 - protein, 9 aa, Homo Sapiens
ETVHIVALD

SEQ ID NO: 1382057 - protein, 9 aa, Homo Sapiens
VFSELSFPL

SEQ ID NO: 1382058 - protein, 9 aa, Homo Sapiens
RSRYTQENI

SEQ ID NO: 1382059 - protein, 9 aa, Homo Sapiens
SVMVGTEEE

SEQ ID NO: 1382060 - protein, 9 aa, Homo Sapiens
CDHHGDTLE

SEQ ID NO: 1382061 - protein, 9 aa, Homo Sapiens
QRTLYRDGM

SEQ ID NO: 1382062 - protein, 9 aa, Homo Sapiens
FSCNLRTAY

SEQ ID NO: 1382063 - protein, 9 aa, Homo Sapiens
GELRYYFLV

SEQ ID NO: 1382064 - protein, 9 aa, Homo Sapiens
AGDVPFNHE

SEQ ID NO: 1382065 - protein, 9 aa, Homo Sapiens
KEEEEEGFD

SEQ ID NO: 1382066 - protein, 9 aa, Homo Sapiens
GKTPWLNHV

SEQ ID NO: 1382067 - protein, 9 aa, Homo Sapiens
AKTAVRRAA

SEQ ID NO: 1382068 - protein, 9 aa, Homo Sapiens
SSKASSIDT

SEQ ID NO: 1382069 - protein, 9 aa, Homo Sapiens
KGWGGDCPK

SEQ ID NO: 1382070 - protein, 9 aa, Homo Sapiens
PPQEGPHIP

SEQ ID NO: 1382071 - protein, 9 aa, Homo Sapiens
APPAGVGLP

SEQ ID NO: 1382072 - protein, 9 aa, Homo Sapiens
RYTQENICQ

SEQ ID NO: 1382073 - protein, 9 aa, Homo Sapiens
IRVVSFTEL

SEQ ID NO: 1382074 - protein, 9 aa, Homo Sapiens
RVSMCAAFC

SEQ ID NO: 1382075 - protein, 9 aa, Homo Sapiens
KYYQKCDWF

SEQ ID NO: 1382076 - protein, 9 aa, Homo Sapiens
TIRYVALKL

SEQ ID NO: 1382077 - protein, 9 aa, Homo Sapiens
ARAPEASWS

SEQ ID NO: 1382078 - protein, 9 aa, Homo Sapiens
SLWPEDRPL

SEQ ID NO: 1382079 - protein, 9 aa, Homo Sapiens
HWVLGISWS

SEQ ID NO: 1382080 - protein, 9 aa, Homo Sapiens
ENVKAKVQD

SEQ ID NO: 1382081 - protein, 9 aa, Homo Sapiens
YSAATAAGI

SEQ ID NO: 1382082 - protein, 9 aa, Homo Sapiens
SPTHPLLLP

SEQ ID NO: 1382083 - protein, 9 aa, Homo Sapiens
RMGTPRLEK

SEQ ID NO: 1382084 - protein, 9 aa, Homo Sapiens
QLRNHYIIR

SEQ ID NO: 1382085 - protein, 9 aa, Homo Sapiens
NKSLSVLVS

SEQ ID NO: 1382086 - protein, 9 aa, Homo Sapiens
QIRATPEAS

SEQ ID NO: 1382087 - protein, 9 aa, Homo Sapiens
TIVLKAVLG

SEQ ID NO: 1382088 - protein, 9 aa, Homo Sapiens
SPKQATQPK

SEQ ID NO: 1382089 - protein, 9 aa, Homo Sapiens
RTAAVGKAR

SEQ ID NO: 1382090 - protein, 9 aa, Homo Sapiens
NYSPGGLPL

SEQ ID NO: 1382091 - protein, 9 aa, Homo Sapiens
NIHLIVHQR

SEQ ID NO: 1382092 - protein, 9 aa, Homo Sapiens
TKKNSIGEK

SEQ ID NO: 1382093 - protein, 9 aa, Homo Sapiens
RATPEASAI

SEQ ID NO: 1382094 - protein, 9 aa, Homo Sapiens
ASFSHHSVS

SEQ ID NO: 1382095 - protein, 9 aa, Homo Sapiens
PKFHYDNTP

SEQ ID NO: 1382096 - protein, 9 aa, Homo Sapiens
STATFLASK

SEQ ID NO: 1382097 - protein, 9 aa, Homo Sapiens
NHIFHERFP

SEQ ID NO: 1382098 - protein, 9 aa, Homo Sapiens
LHSRVQLPI

SEQ ID NO: 1382099 - protein, 9 aa, Homo Sapiens
GLCHGGRHL

SEQ ID NO: 1382100 - protein, 9 aa, Homo Sapiens
LEPGSPYKF

SEQ ID NO: 1382101 - protein, 9 aa, Homo Sapiens
AALVDIVRS

SEQ ID NO: 1382102 - protein, 9 aa, Homo Sapiens
CFKWTCTVS

SEQ ID NO: 1382103 - protein, 9 aa, Homo Sapiens
RGRRGQDLA

SEQ ID NO: 1382104 - protein, 9 aa, Homo Sapiens
VRLLGAVSK

SEQ ID NO: 1382105 - protein, 9 aa, Homo Sapiens
GPHIPGDGA

SEQ ID NO: 1382106 - protein, 9 aa, Homo Sapiens
AVKEKSYCQ

SEQ ID NO: 1382107 - protein, 9 aa, Homo Sapiens
GLWREQQHP

SEQ ID NO: 1382108 - protein, 9 aa, Homo Sapiens
RLRQLEKIS

SEQ ID NO: 1382109 - protein, 9 aa, Homo Sapiens
APPIRRVSP

SEQ ID NO: 1382110 - protein, 9 aa, Homo Sapiens
NYAAVFAQF

SEQ ID NO: 1382111 - protein, 9 aa, Homo Sapiens
GTPRLEKLW

SEQ ID NO: 1382112 - protein, 9 aa, Homo Sapiens
IRDEKGEIE

SEQ ID NO: 1382113 - protein, 9 aa, Homo Sapiens
KVNPDDRLT

SEQ ID NO: 1382114 - protein, 9 aa, Homo Sapiens
EAISEGLRS

SEQ ID NO: 1382115 - protein, 9 aa, Homo Sapiens
VLVSPEAIQ

SEQ ID NO: 1382116 - protein, 9 aa, Homo Sapiens
LLQIAQELE

SEQ ID NO: 1382117 - protein, 9 aa, Homo Sapiens
TDFVAEYID

SEQ ID NO: 1382118 - protein, 9 aa, Homo Sapiens
QANARLTAT

SEQ ID NO: 1382119 - protein, 9 aa, Homo Sapiens
GFLTALLAL

SEQ ID NO: 1382120 - protein, 9 aa, Homo Sapiens
GISWSPDGR

SEQ ID NO: 1382121 - protein, 9 aa, Homo Sapiens
WLQLQPAVC

SEQ ID NO: 1382122 - protein, 9 aa, Homo Sapiens
VCLNYCDEL

SEQ ID NO: 1382123 - protein, 9 aa, Homo Sapiens
EVEETRCFI

SEQ ID NO: 1382124 - protein, 9 aa, Homo Sapiens
LGAFGQFWG

SEQ ID NO: 1382125 - protein, 9 aa, Homo Sapiens
KGSVSTIIR

SEQ ID NO: 1382126 - protein, 9 aa, Homo Sapiens
KSIPLRDGG

SEQ ID NO: 1382127 - protein, 9 aa, Homo Sapiens
ISTPTSPDS

SEQ ID NO: 1382128 - protein, 9 aa, Homo Sapiens
QTARAPEAS

SEQ ID NO: 1382129 - protein, 9 aa, Homo Sapiens
EHESTKRRK

SEQ ID NO: 1382130 - protein, 9 aa, Homo Sapiens
TPQVPRLPA

SEQ ID NO: 1382131 - protein, 9 aa, Homo Sapiens
PWYVLLCVS

SEQ ID NO: 1382132 - protein, 9 aa, Homo Sapiens
TKRRKKQAE

SEQ ID NO: 1382133 - protein, 9 aa, Homo Sapiens
ACGPKEDAG

SEQ ID NO: 1382134 - protein, 9 aa, Homo Sapiens
SQAVGRQLG

SEQ ID NO: 1382135 - protein, 9 aa, Homo Sapiens
RERMEQQRS

SEQ ID NO: 1382136 - protein, 9 aa, Homo Sapiens
GEVLSSIFF

SEQ ID NO: 1382137 - protein, 9 aa, Homo Sapiens
LAFQQHAPV

SEQ ID NO: 1382138 - protein, 9 aa, Homo Sapiens
AVCPRHPLP

SEQ ID NO: 1382139 - protein, 9 aa, Homo Sapiens
DKLWEQIYA

SEQ ID NO: 1382140 - protein, 9 aa, Homo Sapiens
FVLPYQDPD

SEQ ID NO: 1382141 - protein, 9 aa, Homo Sapiens
GWGAQALMP

SEQ ID NO: 1382142 - protein, 9 aa, Homo Sapiens
WTCTVSRYK

SEQ ID NO: 1382143 - protein, 9 aa, Homo Sapiens
THSSAQIHQ

SEQ ID NO: 1382144 - protein, 9 aa, Homo Sapiens
QCYWRLLKA

SEQ ID NO: 1382145 - protein, 9 aa, Homo Sapiens
MELRRLGDE

SEQ ID NO: 1382146 - protein, 9 aa, Homo Sapiens
ARGGKWRSG

SEQ ID NO: 1382147 - protein, 9 aa, Homo Sapiens
PGHRQQPTD

SEQ ID NO: 1382148 - protein, 9 aa, Homo Sapiens
HLQAQQRHQ

SEQ ID NO: 1382149 - protein, 9 aa, Homo Sapiens
KAFIWSPTL

SEQ ID NO: 1382150 - protein, 9 aa, Homo Sapiens
IQVPSNPPR

SEQ ID NO: 1382151 - protein, 9 aa, Homo Sapiens
WHYCTLTIR

SEQ ID NO: 1382152 - protein, 9 aa, Homo Sapiens
RGSHRGVPL

SEQ ID NO: 1382153 - protein, 9 aa, Homo Sapiens
TATFLASKD

SEQ ID NO: 1382154 - protein, 9 aa, Homo Sapiens
CTLHPSGEI

SEQ ID NO: 1382155 - protein, 9 aa, Homo Sapiens
ELDQREKAK

SEQ ID NO: 1382156 - protein, 9 aa, Homo Sapiens
EEFSIVRPI

SEQ ID NO: 1382157 - protein, 9 aa, Homo Sapiens
WIRSSHSMT

SEQ ID NO: 1382158 - protein, 9 aa, Homo Sapiens
RILWFKVVT

SEQ ID NO: 1382159 - protein, 9 aa, Homo Sapiens
MTPTEEEKE

SEQ ID NO: 1382160 - protein, 9 aa, Homo Sapiens
CRWQCIECK

SEQ ID NO: 1382161 - protein, 9 aa, Homo Sapiens
SPRGKPVGK

SEQ ID NO: 1382162 - protein, 9 aa, Homo Sapiens
LGWTELARE

SEQ ID NO: 1382163 - protein, 9 aa, Homo Sapiens
MGGHVQARR

SEQ ID NO: 1382164 - protein, 9 aa, Homo Sapiens
LGRGRRGQD

SEQ ID NO: 1382165 - protein, 9 aa, Homo Sapiens
YSEHNYCRL

SEQ ID NO: 1382166 - protein, 9 aa, Homo Sapiens
VRQIYSEHN

SEQ ID NO: 1382167 - protein, 9 aa, Homo Sapiens
GTNVFVPQR

SEQ ID NO: 1382168 - protein, 9 aa, Homo Sapiens
RWGADAYQS

SEQ ID NO: 1382169 - protein, 9 aa, Homo Sapiens
KKDSQNCED

SEQ ID NO: 1382170 - protein, 9 aa, Homo Sapiens
STTSSERGE

SEQ ID NO: 1382171 - protein, 9 aa, Homo Sapiens
EVRKEHEIR

SEQ ID NO: 1382172 - protein, 9 aa, Homo Sapiens
PDNSESVTT

SEQ ID NO: 1382173 - protein, 9 aa, Homo Sapiens
DYGSAQGAP

SEQ ID NO: 1382174 - protein, 9 aa, Homo Sapiens
ALTKKKERA

SEQ ID NO: 1382175 - protein, 9 aa, Homo Sapiens
KEAYSAATA

SEQ ID NO: 1382176 - protein, 9 aa, Homo Sapiens
HKKKHWEKE

SEQ ID NO: 1382177 - protein, 9 aa, Homo Sapiens
FGDLEVAQE

SEQ ID NO: 1382178 - protein, 9 aa, Homo Sapiens
CHRTKVCAV

SEQ ID NO: 1382179 - protein, 9 aa, Homo Sapiens
GKKREPERE

SEQ ID NO: 1382180 - protein, 9 aa, Homo Sapiens
VFETSSYGT

SEQ ID NO: 1382181 - protein, 9 aa, Homo Sapiens
TIALTLGVE

SEQ ID NO: 1382182 - protein, 9 aa, Homo Sapiens
NRQKSLKDE

SEQ ID NO: 1382183 - protein, 9 aa, Homo Sapiens
CAPGTQVRA

SEQ ID NO: 1382184 - protein, 9 aa, Homo Sapiens
EAGDVPFNH

SEQ ID NO: 1382185 - protein, 9 aa, Homo Sapiens
YVALKLKLR

SEQ ID NO: 1382186 - protein, 9 aa, Homo Sapiens
AVNMMCQHT

SEQ ID NO: 1382187 - protein, 9 aa, Homo Sapiens
LLQEDLAYS

SEQ ID NO: 1382188 - protein, 9 aa, Homo Sapiens
NDSNITVLG

SEQ ID NO: 1382189 - protein, 9 aa, Homo Sapiens
LLIASFSHH

SEQ ID NO: 1382190 - protein, 9 aa, Homo Sapiens
KRQHNFTLA

SEQ ID NO: 1382191 - protein, 9 aa, Homo Sapiens
SHFDSLYFC

SEQ ID NO: 1382192 - protein, 9 aa, Homo Sapiens
KSEKRILLS

SEQ ID NO: 1382193 - protein, 9 aa, Homo Sapiens
AERIVELLG

SEQ ID NO: 1382194 - protein, 9 aa, Homo Sapiens
KCFEIMNPK

SEQ ID NO: 1382195 - protein, 9 aa, Homo Sapiens
LLSQFPLNS

SEQ ID NO: 1382196 - protein, 9 aa, Homo Sapiens
IALTLGVER

SEQ ID NO: 1382197 - protein, 9 aa, Homo Sapiens
HAWPITPTP

SEQ ID NO: 1382198 - protein, 9 aa, Homo Sapiens
ERTHERERD

SEQ ID NO: 1382199 - protein, 9 aa, Homo Sapiens
DCFSDSGVC

SEQ ID NO: 1382200 - protein, 9 aa, Homo Sapiens
AMTVTTSGF

SEQ ID NO: 1382201 - protein, 9 aa, Homo Sapiens
VLGISWSPD

SEQ ID NO: 1382202 - protein, 9 aa, Homo Sapiens
NERLPSLGL

SEQ ID NO: 1382203 - protein, 9 aa, Homo Sapiens
GRGRRGQDL

SEQ ID NO: 1382204 - protein, 9 aa, Homo Sapiens
QYDAYGPAG

SEQ ID NO: 1382205 - protein, 9 aa, Homo Sapiens
RGRGRPCGR

SEQ ID NO: 1382206 - protein, 9 aa, Homo Sapiens
HRLGRGRRG

SEQ ID NO: 1382207 - protein, 9 aa, Homo Sapiens
TWGCPFHDG

SEQ ID NO: 1382208 - protein, 9 aa, Homo Sapiens
DRQLQLVTY

SEQ ID NO: 1382209 - protein, 9 aa, Homo Sapiens
SLLNTTKNF

SEQ ID NO: 1382210 - protein, 9 aa, Homo Sapiens
MIPTNRQPR

SEQ ID NO: 1382211 - protein, 9 aa, Homo Sapiens
GLPGSVPGK

SEQ ID NO: 1382212 - protein, 9 aa, Homo Sapiens
VLEPSPISL

SEQ ID NO: 1382213 - protein, 9 aa, Homo Sapiens
EMKSEKRIL

SEQ ID NO: 1382214 - protein, 9 aa, Homo Sapiens
TMFSIGCAK

SEQ ID NO: 1382215 - protein, 9 aa, Homo Sapiens
VSGFVVFTV

SEQ ID NO: 1382216 - protein, 9 aa, Homo Sapiens
LTGSQSPHA

SEQ ID NO: 1382217 - protein, 9 aa, Homo Sapiens
SAPGTLPKA

SEQ ID NO: 1382218 - protein, 9 aa, Homo Sapiens
KHARTFVVF

SEQ ID NO: 1382219 - protein, 9 aa, Homo Sapiens
HSPLQPVCA

SEQ ID NO: 1382220 - protein, 9 aa, Homo Sapiens
DRGGARAGA

SEQ ID NO: 1382221 - protein, 9 aa, Homo Sapiens
GWRPLGDSL

SEQ ID NO: 1382222 - protein, 9 aa, Homo Sapiens
HKEAHNSWD

SEQ ID NO: 1382223 - protein, 9 aa, Homo Sapiens
EQEVPPCDH

SEQ ID NO: 1382224 - protein, 9 aa, Homo Sapiens
TKILQQQQL

SEQ ID NO: 1382225 - protein, 9 aa, Homo Sapiens
PFLAALVDI

SEQ ID NO: 1382226 - protein, 9 aa, Homo Sapiens
RFGGEHVPS

SEQ ID NO: 1382227 - protein, 9 aa, Homo Sapiens
PVFETSSYG

SEQ ID NO: 1382228 - protein, 9 aa, Homo Sapiens
INFAKGELR

SEQ ID NO: 1382229 - protein, 9 aa, Homo Sapiens
AKRQEAVAK

SEQ ID NO: 1382230 - protein, 9 aa, Homo Sapiens
SNITVLGGE

SEQ ID NO: 1382231 - protein, 9 aa, Homo Sapiens
KGHRHWVLG

SEQ ID NO: 1382232 - protein, 9 aa, Homo Sapiens
RRVCALMLL

SEQ ID NO: 1382233 - protein, 9 aa, Homo Sapiens
QHPAGTRTE

SEQ ID NO: 1382234 - protein, 9 aa, Homo Sapiens
GRHLPLLTW

SEQ ID NO: 1382235 - protein, 9 aa, Homo Sapiens
IRSSHSMTM

SEQ ID NO: 1382236 - protein, 9 aa, Homo Sapiens
DMGGHVQAR

SEQ ID NO: 1382237 - protein, 9 aa, Homo Sapiens
FRSMPPRQA

SEQ ID NO: 1382238 - protein, 9 aa, Homo Sapiens
PLQIIINPA

SEQ ID NO: 1382239 - protein, 9 aa, Homo Sapiens
IPAQQDVLR

SEQ ID NO: 1382240 - protein, 9 aa, Homo Sapiens
LFETCSHIK

SEQ ID NO: 1382241 - protein, 9 aa, Homo Sapiens
VTVLEYDAR

SEQ ID NO: 1382242 - protein, 9 aa, Homo Sapiens
AKKHTMPFW

SEQ ID NO: 1382243 - protein, 9 aa, Homo Sapiens
VKEDEDGGV

SEQ ID NO: 1382244 - protein, 9 aa, Homo Sapiens
NKVLYPPLR

SEQ ID NO: 1382245 - protein, 9 aa, Homo Sapiens
LIKTAQPYR

SEQ ID NO: 1382246 - protein, 9 aa, Homo Sapiens
SAKFPKDKF

SEQ ID NO: 1382247 - protein, 9 aa, Homo Sapiens
IVPFPVRRA

SEQ ID NO: 1382248 - protein, 9 aa, Homo Sapiens
VQGKKILFH

SEQ ID NO: 1382249 - protein, 9 aa, Homo Sapiens
KKCAVSVET

SEQ ID NO: 1382250 - protein, 9 aa, Homo Sapiens
RKGGVVTIL

SEQ ID NO: 1382251 - protein, 9 aa, Homo Sapiens
QSACHGYCA

SEQ ID NO: 1382252 - protein, 9 aa, Homo Sapiens
FSEIRIHPP

SEQ ID NO: 1382253 - protein, 9 aa, Homo Sapiens
KKLERERME

SEQ ID NO: 1382254 - protein, 9 aa, Homo Sapiens
GCLKVNPDD

SEQ ID NO: 1382255 - protein, 9 aa, Homo Sapiens
AVPVKRWSL

SEQ ID NO: 1382256 - protein, 9 aa, Homo Sapiens
RRHSWSGVA

SEQ ID NO: 1382257 - protein, 9 aa, Homo Sapiens
PECGPVVAG

SEQ ID NO: 1382258 - protein, 9 aa, Homo Sapiens
ICPEGPHRP

SEQ ID NO: 1382259 - protein, 9 aa, Homo Sapiens
IKTPPKCPG

SEQ ID NO: 1382260 - protein, 9 aa, Homo Sapiens
KWKKGLGKG

SEQ ID NO: 1382261 - protein, 9 aa, Homo Sapiens
DYIPAQQDV

SEQ ID NO: 1382262 - protein, 9 aa, Homo Sapiens
AEKITGDLE

SEQ ID NO: 1382263 - protein, 9 aa, Homo Sapiens
LCHGGRHLP

SEQ ID NO: 1382264 - protein, 9 aa, Homo Sapiens
GTWTCSAPA

SEQ ID NO: 1382265 - protein, 9 aa, Homo Sapiens
CSHIKEKLD

SEQ ID NO: 1382266 - protein, 9 aa, Homo Sapiens
EEGKAAWAE

SEQ ID NO: 1382267 - protein, 9 aa, Homo Sapiens
SPAPSTPAT

SEQ ID NO: 1382268 - protein, 9 aa, Homo Sapiens
VCALMLLAA

SEQ ID NO: 1382269 - protein, 9 aa, Homo Sapiens
YPGQQQDYG

SEQ ID NO: 1382270 - protein, 9 aa, Homo Sapiens
LHSEFDGQH

SEQ ID NO: 1382271 - protein, 9 aa, Homo Sapiens
RKSAECKSR

SEQ ID NO: 1382272 - protein, 9 aa, Homo Sapiens
QRLASEFHA

SEQ ID NO: 1382273 - protein, 9 aa, Homo Sapiens
QLFTTRKEH

SEQ ID NO: 1382274 - protein, 9 aa, Homo Sapiens
ITMNRRVCA

SEQ ID NO: 1382275 - protein, 9 aa, Homo Sapiens
VGVDGEIVY

SEQ ID NO: 1382276 - protein, 9 aa, Homo Sapiens
LIELAESFK

SEQ ID NO: 1382277 - protein, 9 aa, Homo Sapiens
SPMQNNRRE

SEQ ID NO: 1382278 - protein, 9 aa, Homo Sapiens
GDEKELDQR

SEQ ID NO: 1382279 - protein, 9 aa, Homo Sapiens
WINAGTVHL

SEQ ID NO: 1382280 - protein, 9 aa, Homo Sapiens
AVFAQFIID

SEQ ID NO: 1382281 - protein, 9 aa, Homo Sapiens
MPARGGKWR

SEQ ID NO: 1382282 - protein, 9 aa, Homo Sapiens
IQEKGSVST

SEQ ID NO: 1382283 - protein, 9 aa, Homo Sapiens
SITIAVSSA

SEQ ID NO: 1382284 - protein, 9 aa, Homo Sapiens
IARARNREY

SEQ ID NO: 1382285 - protein, 9 aa, Homo Sapiens
KDFGKNDCK

SEQ ID NO: 1382286 - protein, 9 aa, Homo Sapiens
SLTVQNSPK

SEQ ID NO: 1382287 - protein, 9 aa, Homo Sapiens
VIYASQTEQ

SEQ ID NO: 1382288 - protein, 9 aa, Homo Sapiens
LETNIPQRS

SEQ ID NO: 1382289 - protein, 9 aa, Homo Sapiens
HTHSSAQIH

SEQ ID NO: 1382290 - protein, 9 aa, Homo Sapiens
TSLVQRDRL

SEQ ID NO: 1382291 - protein, 9 aa, Homo Sapiens
KRWSLSCRN

SEQ ID NO: 1382292 - protein, 9 aa, Homo Sapiens
KDTVIVVSE

SEQ ID NO: 1382293 - protein, 9 aa, Homo Sapiens
VARVEVAAG

SEQ ID NO: 1382294 - protein, 9 aa, Homo Sapiens
PGQQQDYGS

SEQ ID NO: 1382295 - protein, 9 aa, Homo Sapiens
HRGVPLVAG

SEQ ID NO: 1382296 - protein, 9 aa, Homo Sapiens
SAFFKGRVS

SEQ ID NO: 1382297 - protein, 9 aa, Homo Sapiens
LERGDLGYL

SEQ ID NO: 1382298 - protein, 9 aa, Homo Sapiens
EATRGHHEY

SEQ ID NO: 1382299 - protein, 9 aa, Homo Sapiens
WVLGISWSP

SEQ ID NO: 1382300 - protein, 9 aa, Homo Sapiens
PRHPRHHQT

SEQ ID NO: 1382301 - protein, 9 aa, Homo Sapiens
TVRVLQAFL

SEQ ID NO: 1382302 - protein, 9 aa, Homo Sapiens
NSLPPKKIK

SEQ ID NO: 1382303 - protein, 9 aa, Homo Sapiens
LRHAWPITP

SEQ ID NO: 1382304 - protein, 9 aa, Homo Sapiens
DNQGRSRAK

SEQ ID NO: 1382305 - protein, 9 aa, Homo Sapiens
QPKKCPCRT

SEQ ID NO: 1382306 - protein, 9 aa, Homo Sapiens
AFFKGRVSM

SEQ ID NO: 1382307 - protein, 9 aa, Homo Sapiens
RGPAALHPG

SEQ ID NO: 1382308 - protein, 9 aa, Homo Sapiens
HNIPQQEVV

SEQ ID NO: 1382309 - protein, 9 aa, Homo Sapiens
RESLGTAWV

SEQ ID NO: 1382310 - protein, 9 aa, Homo Sapiens
QTTASSIPS

SEQ ID NO: 1382311 - protein, 9 aa, Homo Sapiens
QQGIALQST

SEQ ID NO: 1382312 - protein, 9 aa, Homo Sapiens
KKQISRSSQ

SEQ ID NO: 1382313 - protein, 9 aa, Homo Sapiens
LEECIISAV

SEQ ID NO: 1382314 - protein, 9 aa, Homo Sapiens
QHAPVECQL

SEQ ID NO: 1382315 - protein, 9 aa, Homo Sapiens
VQATSVEVT

SEQ ID NO: 1382316 - protein, 9 aa, Homo Sapiens
VWTPADQRR

SEQ ID NO: 1382317 - protein, 9 aa, Homo Sapiens
LLNTTKNFS

SEQ ID NO: 1382318 - protein, 9 aa, Homo Sapiens
LAFRKGGVV

SEQ ID NO: 1382319 - protein, 9 aa, Homo Sapiens
QLLTDPKEQ

SEQ ID NO: 1382320 - protein, 9 aa, Homo Sapiens
IMNPKSFIY

SEQ ID NO: 1382321 - protein, 9 aa, Homo Sapiens
GEYGGGYGP

SEQ ID NO: 1382322 - protein, 9 aa, Homo Sapiens
RDPGHRQQP

SEQ ID NO: 1382323 - protein, 9 aa, Homo Sapiens
RLAYLHEDI

SEQ ID NO: 1382324 - protein, 9 aa, Homo Sapiens
LEPSPISLP

SEQ ID NO: 1382325 - protein, 9 aa, Homo Sapiens
VASSSGGRT

SEQ ID NO: 1382326 - protein, 9 aa, Homo Sapiens
PEFEEDGDF

SEQ ID NO: 1382327 - protein, 9 aa, Homo Sapiens
AAPRPANYS

SEQ ID NO: 1382328 - protein, 9 aa, Homo Sapiens
PASGSGLGP

SEQ ID NO: 1382329 - protein, 9 aa, Homo Sapiens
PRMIVTPPE

SEQ ID NO: 1382330 - protein, 9 aa, Homo Sapiens
TPPLPPRRT

SEQ ID NO: 1382331 - protein, 9 aa, Homo Sapiens
GGGEYGGGY

SEQ ID NO: 1382332 - protein, 9 aa, Homo Sapiens
VGPSEAPGQ

SEQ ID NO: 1382333 - protein, 9 aa, Homo Sapiens
IAHIKAKGA

SEQ ID NO: 1382334 - protein, 9 aa, Homo Sapiens
SPGLDQLDR

SEQ ID NO: 1382335 - protein, 9 aa, Homo Sapiens
WRKSAECKS

SEQ ID NO: 1382336 - protein, 9 aa, Homo Sapiens
SVTTVANFL

SEQ ID NO: 1382337 - protein, 9 aa, Homo Sapiens
YVHELMTYI

SEQ ID NO: 1382338 - protein, 9 aa, Homo Sapiens
CFLTLPLTI

SEQ ID NO: 1382339 - protein, 9 aa, Homo Sapiens
DHHGDTLEG

SEQ ID NO: 1382340 - protein, 9 aa, Homo Sapiens
AKVQGQAAH

SEQ ID NO: 1382341 - protein, 9 aa, Homo Sapiens
VEHESTKRR

SEQ ID NO: 1382342 - protein, 9 aa, Homo Sapiens
TPAAAPSSL

SEQ ID NO: 1382343 - protein, 9 aa, Homo Sapiens
TNPPQLKEL

SEQ ID NO: 1382344 - protein, 9 aa, Homo Sapiens
PCRTLQTSS

SEQ ID NO: 1382345 - protein, 9 aa, Homo Sapiens
TTAMLSFSE

SEQ ID NO: 1382346 - protein, 9 aa, Homo Sapiens
PLGETHSHS

SEQ ID NO: 1382347 - protein, 9 aa, Homo Sapiens
HEWIGNERL

SEQ ID NO: 1382348 - protein, 9 aa, Homo Sapiens
LDTAGHQRP

SEQ ID NO: 1382349 - protein, 9 aa, Homo Sapiens
RPVNGVINI

SEQ ID NO: 1382350 - protein, 9 aa, Homo Sapiens
EMELRRLGD

SEQ ID NO: 1382351 - protein, 9 aa, Homo Sapiens
FSQNIHLIV

SEQ ID NO: 1382352 - protein, 9 aa, Homo Sapiens
DPDGENKRS

SEQ ID NO: 1382353 - protein, 9 aa, Homo Sapiens
ISHSPLQPV

SEQ ID NO: 1382354 - protein, 9 aa, Homo Sapiens
WAASPAADN

SEQ ID NO: 1382355 - protein, 9 aa, Homo Sapiens
DIKCVKSLV

SEQ ID NO: 1382356 - protein, 9 aa, Homo Sapiens
SPSQPKKCP

SEQ ID NO: 1382357 - protein, 9 aa, Homo Sapiens
KVQGQAAHP

SEQ ID NO: 1382358 - protein, 9 aa, Homo Sapiens
YGLVAPPFP

SEQ ID NO: 1382359 - protein, 9 aa, Homo Sapiens
ARSSCEDPG

SEQ ID NO: 1382360 - protein, 9 aa, Homo Sapiens
VQWWLLQIA

SEQ ID NO: 1382361 - protein, 9 aa, Homo Sapiens
CCMKTGLRC

SEQ ID NO: 1382362 - protein, 9 aa, Homo Sapiens
NIRKNVFKE

SEQ ID NO: 1382363 - protein, 9 aa, Homo Sapiens
ENPAVPCVP

SEQ ID NO: 1382364 - protein, 9 aa, Homo Sapiens
TVPLQHHVW

SEQ ID NO: 1382365 - protein, 9 aa, Homo Sapiens
HSEYQQSPV

SEQ ID NO: 1382366 - protein, 9 aa, Homo Sapiens
IPQDICPDQ

SEQ ID NO: 1382367 - protein, 9 aa, Homo Sapiens
EDPALLVPH

SEQ ID NO: 1382368 - protein, 9 aa, Homo Sapiens
NIENAFLSG

SEQ ID NO: 1382369 - protein, 9 aa, Homo Sapiens
ATTAIGGGV

SEQ ID NO: 1382370 - protein, 9 aa, Homo Sapiens
LKCPDYDRM

SEQ ID NO: 1382371 - protein, 9 aa, Homo Sapiens
FEEDGDFVI

SEQ ID NO: 1382372 - protein, 9 aa, Homo Sapiens
VLAGGASWA

SEQ ID NO: 1382373 - protein, 9 aa, Homo Sapiens
HRWTGTGKN

SEQ ID NO: 1382374 - protein, 9 aa, Homo Sapiens
WTWEGCTWK

SEQ ID NO: 1382375 - protein, 9 aa, Homo Sapiens
TINLLEELS

SEQ ID NO: 1382376 - protein, 9 aa, Homo Sapiens
MGGKTPWLN

SEQ ID NO: 1382377 - protein, 9 aa, Homo Sapiens
GDVPFNHEI

SEQ ID NO: 1382378 - protein, 9 aa, Homo Sapiens
AVEMLKFEA

SEQ ID NO: 1382379 - protein, 9 aa, Homo Sapiens
TPTSPDSLR

SEQ ID NO: 1382380 - protein, 9 aa, Homo Sapiens
TYGYSTPTS

SEQ ID NO: 1382381 - protein, 9 aa, Homo Sapiens
SEIFELSEL

SEQ ID NO: 1382382 - protein, 9 aa, Homo Sapiens
KGDEKELDQ

SEQ ID NO: 1382383 - protein, 9 aa, Homo Sapiens
KEPWKAKRQ

SEQ ID NO: 1382384 - protein, 9 aa, Homo Sapiens
AHPTDPGSP

SEQ ID NO: 1382385 - protein, 9 aa, Homo Sapiens
DEDGGVGDG

SEQ ID NO: 1382386 - protein, 9 aa, Homo Sapiens
KDFKKGSWC

SEQ ID NO: 1382387 - protein, 9 aa, Homo Sapiens
GSPYKFLTS

SEQ ID NO: 1382388 - protein, 9 aa, Homo Sapiens
DCPKGPQNP

SEQ ID NO: 1382389 - protein, 9 aa, Homo Sapiens
HSNHGSLRQ

SEQ ID NO: 1382390 - protein, 9 aa, Homo Sapiens
ADHLGLGWT

SEQ ID NO: 1382391 - protein, 9 aa, Homo Sapiens
QNPQAPEAP

SEQ ID NO: 1382392 - protein, 9 aa, Homo Sapiens
CRNVWSLPA

SEQ ID NO: 1382393 - protein, 9 aa, Homo Sapiens
LLVAYMLSV

SEQ ID NO: 1382394 - protein, 9 aa, Homo Sapiens
WGLETNIPQ

SEQ ID NO: 1382395 - protein, 9 aa, Homo Sapiens
SSYHSKHLK

SEQ ID NO: 1382396 - protein, 9 aa, Homo Sapiens
DQLDRQLQL

SEQ ID NO: 1382397 - protein, 9 aa, Homo Sapiens
MLSMGGPET

SEQ ID NO: 1382398 - protein, 9 aa, Homo Sapiens
QWWLLQIAQ

SEQ ID NO: 1382399 - protein, 9 aa, Homo Sapiens
HLEALQLGR

SEQ ID NO: 1382400 - protein, 9 aa, Homo Sapiens
SHAVKIDGL

SEQ ID NO: 1382401 - protein, 9 aa, Homo Sapiens
RRTVTCQIM

SEQ ID NO: 1382402 - protein, 9 aa, Homo Sapiens
STKRRKKQA

SEQ ID NO: 1382403 - protein, 9 aa, Homo Sapiens
PLQHHVWTP

SEQ ID NO: 1382404 - protein, 9 aa, Homo Sapiens
LAIALFTSA

SEQ ID NO: 1382405 - protein, 9 aa, Homo Sapiens
LTASGNSFD

SEQ ID NO: 1382406 - protein, 9 aa, Homo Sapiens
CWQGWALSL

SEQ ID NO: 1382407 - protein, 9 aa, Homo Sapiens
PPYVFMCPQ

SEQ ID NO: 1382408 - protein, 9 aa, Homo Sapiens
HYDNTPGIS

SEQ ID NO: 1382409 - protein, 9 aa, Homo Sapiens
EAITLCSSL

SEQ ID NO: 1382410 - protein, 9 aa, Homo Sapiens
RLPSLGLPQ

SEQ ID NO: 1382411 - protein, 9 aa, Homo Sapiens
VRTATTNRA

SEQ ID NO: 1382412 - protein, 9 aa, Homo Sapiens
DPKEQRKES

SEQ ID NO: 1382413 - protein, 9 aa, Homo Sapiens
KELDQREKA

SEQ ID NO: 1382414 - protein, 9 aa, Homo Sapiens
LLDDGEVED

SEQ ID NO: 1382415 - protein, 9 aa, Homo Sapiens
ASPPAARRW

SEQ ID NO: 1382416 - protein, 9 aa, Homo Sapiens
LPHIWKVPD

SEQ ID NO: 1382417 - protein, 9 aa, Homo Sapiens
RDRLESEGN

SEQ ID NO: 1382418 - protein, 9 aa, Homo Sapiens
LLRPLTPGV

SEQ ID NO: 1382419 - protein, 9 aa, Homo Sapiens
NVKAKVQDK

SEQ ID NO: 1382420 - protein, 9 aa, Homo Sapiens
AVRARALSS

SEQ ID NO: 1382421 - protein, 9 aa, Homo Sapiens
AVVASSSGG

SEQ ID NO: 1382422 - protein, 9 aa, Homo Sapiens
LQNESVEKT

SEQ ID NO: 1382423 - protein, 9 aa, Homo Sapiens
SCLGAFGQF

SEQ ID NO: 1382424 - protein, 9 aa, Homo Sapiens
AQWGGESSG

SEQ ID NO: 1382425 - protein, 9 aa, Homo Sapiens
NFAKGELRY

SEQ ID NO: 1382426 - protein, 9 aa, Homo Sapiens
CAGHTHSSA

SEQ ID NO: 1382427 - protein, 9 aa, Homo Sapiens
ELQNHTLTQ

SEQ ID NO: 1382428 - protein, 9 aa, Homo Sapiens
GWTELAREL

SEQ ID NO: 1382429 - protein, 9 aa, Homo Sapiens
LEKVSKKKD

SEQ ID NO: 1382430 - protein, 9 aa, Homo Sapiens
HVIWKGILD

SEQ ID NO: 1382431 - protein, 9 aa, Homo Sapiens
STPTSPTHP

SEQ ID NO: 1382432 - protein, 9 aa, Homo Sapiens
AAVFAQFII

SEQ ID NO: 1382433 - protein, 9 aa, Homo Sapiens
NKGFDLCVV

SEQ ID NO: 1382434 - protein, 9 aa, Homo Sapiens
DSLRKHKDL

SEQ ID NO: 1382435 - protein, 9 aa, Homo Sapiens
SINPVKQEE

SEQ ID NO: 1382436 - protein, 9 aa, Homo Sapiens
GQFWGGLSQ

SEQ ID NO: 1382437 - protein, 9 aa, Homo Sapiens
NGKFQLPGQ

SEQ ID NO: 1382438 - protein, 9 aa, Homo Sapiens
QKEALVTIR

SEQ ID NO: 1382439 - protein, 9 aa, Homo Sapiens
REREKKGRS

SEQ ID NO: 1382440 - protein, 9 aa, Homo Sapiens
WPQWLHQQT

SEQ ID NO: 1382441 - protein, 9 aa, Homo Sapiens
EVTVAGFQP

SEQ ID NO: 1382442 - protein, 9 aa, Homo Sapiens
APATVPGLW

SEQ ID NO: 1382443 - protein, 9 aa, Homo Sapiens
QLQPAVCPR

SEQ ID NO: 1382444 - protein, 9 aa, Homo Sapiens
EPPCTRLHG

SEQ ID NO: 1382445 - protein, 9 aa, Homo Sapiens
VCSRTPVET

SEQ ID NO: 1382446 - protein, 9 aa, Homo Sapiens
LEELSLNYF

SEQ ID NO: 1382447 - protein, 9 aa, Homo Sapiens
GPHHSLPAR

SEQ ID NO: 1382448 - protein, 9 aa, Homo Sapiens
PDGENKRST

SEQ ID NO: 1382449 - protein, 9 aa, Homo Sapiens
RREQEVPPC

SEQ ID NO: 1382450 - protein, 9 aa, Homo Sapiens
LERERMEQQ

SEQ ID NO: 1382451 - protein, 9 aa, Homo Sapiens
NHSSRLTLE

SEQ ID NO: 1382452 - protein, 9 aa, Homo Sapiens
QHHVWTPAD

SEQ ID NO: 1382453 - protein, 9 aa, Homo Sapiens
TTVANFLSL

SEQ ID NO: 1382454 - protein, 9 aa, Homo Sapiens
SGFLTALLA

SEQ ID NO: 1382455 - protein, 9 aa, Homo Sapiens
QQHNIPQQE

SEQ ID NO: 1382456 - protein, 9 aa, Homo Sapiens
LGAVSKGQP

SEQ ID NO: 1382457 - protein, 9 aa, Homo Sapiens
LTEEEGKAA

SEQ ID NO: 1382458 - protein, 9 aa, Homo Sapiens
QLTVSSLRC

SEQ ID NO: 1382459 - protein, 9 aa, Homo Sapiens
KGLGKGNKS

SEQ ID NO: 1382460 - protein, 9 aa, Homo Sapiens
GMYTCAGTN

SEQ ID NO: 1382461 - protein, 9 aa, Homo Sapiens
SPASGSGLG

SEQ ID NO: 1382462 - protein, 9 aa, Homo Sapiens
RIVELLGLD

SEQ ID NO: 1382463 - protein, 9 aa, Homo Sapiens
LENWLLRSE

SEQ ID NO: 1382464 - protein, 9 aa, Homo Sapiens
NLIWQVFLK

SEQ ID NO: 1382465 - protein, 9 aa, Homo Sapiens
FGLLWGHLV

SEQ ID NO: 1382466 - protein, 9 aa, Homo Sapiens
PGSPPECGP

SEQ ID NO: 1382467 - protein, 9 aa, Homo Sapiens
LGSFVAMPR

SEQ ID NO: 1382468 - protein, 9 aa, Homo Sapiens
NVCLNYCDE

SEQ ID NO: 1382469 - protein, 9 aa, Homo Sapiens
QFPLNSTET

SEQ ID NO: 1382470 - protein, 9 aa, Homo Sapiens
QLFEFFVVV

SEQ ID NO: 1382471 - protein, 9 aa, Homo Sapiens
IFFCERIPK

SEQ ID NO: 1382472 - protein, 9 aa, Homo Sapiens
YVHRVGANS

SEQ ID NO: 1382473 - protein, 9 aa, Homo Sapiens
SLSCKDCMK

SEQ ID NO: 1382474 - protein, 9 aa, Homo Sapiens
VLPAPSRAL

SEQ ID NO: 1382475 - protein, 9 aa, Homo Sapiens
ASGPGPHHS

SEQ ID NO: 1382476 - protein, 9 aa, Homo Sapiens
LMCAPKHAR

SEQ ID NO: 1382477 - protein, 9 aa, Homo Sapiens
GCLPPEPGD

SEQ ID NO: 1382478 - protein, 9 aa, Homo Sapiens
HISSAALPL

SEQ ID NO: 1382479 - protein, 9 aa, Homo Sapiens
QKKKNKEEE

SEQ ID NO: 1382480 - protein, 9 aa, Homo Sapiens
TPVIRKSRG

SEQ ID NO: 1382481 - protein, 9 aa, Homo Sapiens
LFIITNCCL

SEQ ID NO: 1382482 - protein, 9 aa, Homo Sapiens
GTVRVLQAF

SEQ ID NO: 1382483 - protein, 9 aa, Homo Sapiens
SSAKFPKDK

SEQ ID NO: 1382484 - protein, 9 aa, Homo Sapiens
LGETHESHV

SEQ ID NO: 1382485 - protein, 9 aa, Homo Sapiens
HGYCAGHTH

SEQ ID NO: 1382486 - protein, 9 aa, Homo Sapiens
GKAFSQNIH

SEQ ID NO: 1382487 - protein, 9 aa, Homo Sapiens
HIPGDGATV

SEQ ID NO: 1382488 - protein, 9 aa, Homo Sapiens
QQSPVQRQR

SEQ ID NO: 1382489 - protein, 9 aa, Homo Sapiens
SLSVLVSPE

SEQ ID NO: 1382490 - protein, 9 aa, Homo Sapiens
SWSGVAFNL

SEQ ID NO: 1382491 - protein, 9 aa, Homo Sapiens
NWLLRSEKS

SEQ ID NO: 1382492 - protein, 9 aa, Homo Sapiens
HDSTQGKNH

SEQ ID NO: 1382493 - protein, 9 aa, Homo Sapiens
WTLTIQVLP

SEQ ID NO: 1382494 - protein, 9 aa, Homo Sapiens
YDIWEAISE

SEQ ID NO: 1382495 - protein, 9 aa, Homo Sapiens
LNYVISSFY

SEQ ID NO: 1382496 - protein, 9 aa, Homo Sapiens
QTAQDRAGV

SEQ ID NO: 1382497 - protein, 9 aa, Homo Sapiens
CGKAFIWSP

SEQ ID NO: 1382498 - protein, 9 aa, Homo Sapiens
TGLRCGTWT

SEQ ID NO: 1382499 - protein, 9 aa, Homo Sapiens
LGRGPAALW

SEQ ID NO: 1382500 - protein, 9 aa, Homo Sapiens
AVQHCNLAR

SEQ ID NO: 1382501 - protein, 9 aa, Homo Sapiens
LVQRDRLES

SEQ ID NO: 1382502 - protein, 9 aa, Homo Sapiens
RQARLGYEW

SEQ ID NO: 1382503 - protein, 9 aa, Homo Sapiens
RHVIWKGIL

SEQ ID NO: 1382504 - protein, 9 aa, Homo Sapiens
VSELPGLPS

SEQ ID NO: 1382505 - protein, 9 aa, Homo Sapiens
HLWQPDACY

SEQ ID NO: 1382506 - protein, 9 aa, Homo Sapiens
GHRQQPTDP

SEQ ID NO: 1382507 - protein, 9 aa, Homo Sapiens
TWQLWHREL

SEQ ID NO: 1382508 - protein, 9 aa, Homo Sapiens
GAFQAQRAF

SEQ ID NO: 1382509 - protein, 9 aa, Homo Sapiens
YSPEQTALH

SEQ ID NO: 1382510 - protein, 9 aa, Homo Sapiens
QNHTLTQHS

SEQ ID NO: 1382511 - protein, 9 aa, Homo Sapiens
SNVARQLHI

SEQ ID NO: 1382512 - protein, 9 aa, Homo Sapiens
GGKWRSGMD

SEQ ID NO: 1382513 - protein, 9 aa, Homo Sapiens
SESVTTVAN

SEQ ID NO: 1382514 - protein, 9 aa, Homo Sapiens
VVSEPSEDE

SEQ ID NO: 1382515 - protein, 9 aa, Homo Sapiens
LQIIINPAR

SEQ ID NO: 1382516 - protein, 9 aa, Homo Sapiens
VGEVLSSIF

SEQ ID NO: 1382517 - protein, 9 aa, Homo Sapiens
ASSSGGRTA

SEQ ID NO: 1382518 - protein, 9 aa, Homo Sapiens
KACSTRTVP

SEQ ID NO: 1382519 - protein, 9 aa, Homo Sapiens
SLPNMIPTN

SEQ ID NO: 1382520 - protein, 9 aa, Homo Sapiens
GDLGYLVEE

SEQ ID NO: 1382521 - protein, 9 aa, Homo Sapiens
TIDIFFCAN

SEQ ID NO: 1382522 - protein, 9 aa, Homo Sapiens
KTRVSLLNT

SEQ ID NO: 1382523 - protein, 9 aa, Homo Sapiens
EALVTIRSI

SEQ ID NO: 1382524 - protein, 9 aa, Homo Sapiens
SPDQGPNKG

SEQ ID NO: 1382525 - protein, 9 aa, Homo Sapiens
ATTEDLQEA

SEQ ID NO: 1382526 - protein, 9 aa, Homo Sapiens
AVNPWYVLL

SEQ ID NO: 1382527 - protein, 9 aa, Homo Sapiens
SGPRMLWGS

SEQ ID NO: 1382528 - protein, 9 aa, Homo Sapiens
ISPDTKKNS

SEQ ID NO: 1382529 - protein, 9 aa, Homo Sapiens
LEGKAQWGG

SEQ ID NO: 1382530 - protein, 9 aa, Homo Sapiens
ATRGHHEYT

SEQ ID NO: 1382531 - protein, 9 aa, Homo Sapiens
APWTLTIQV

SEQ ID NO: 1382532 - protein, 9 aa, Homo Sapiens
ARACDSITS

SEQ ID NO: 1382533 - protein, 9 aa, Homo Sapiens
LHLQAQQRH

SEQ ID NO: 1382534 - protein, 9 aa, Homo Sapiens
VTPPEQSAC

SEQ ID NO: 1382535 - protein, 9 aa, Homo Sapiens
QGWALSLSG

SEQ ID NO: 1382536 - protein, 9 aa, Homo Sapiens
IEHTETDAV

SEQ ID NO: 1382537 - protein, 9 aa, Homo Sapiens
KLWNGELVT

SEQ ID NO: 1382538 - protein, 9 aa, Homo Sapiens
VAQKKIQDV

SEQ ID NO: 1382539 - protein, 9 aa, Homo Sapiens
RLASEFHAE

SEQ ID NO: 1382540 - protein, 9 aa, Homo Sapiens
NSTETSKVP

SEQ ID NO: 1382541 - protein, 9 aa, Homo Sapiens
YHKEAHNSW

SEQ ID NO: 1382542 - protein, 9 aa, Homo Sapiens
FFLIEKNLI

SEQ ID NO: 1382543 - protein, 9 aa, Homo Sapiens
KCAVSVETR

SEQ ID NO: 1382544 - protein, 9 aa, Homo Sapiens
HAEKLAAVG

SEQ ID NO: 1382545 - protein, 9 aa, Homo Sapiens
LFTTRKEHW

SEQ ID NO: 1382546 - protein, 9 aa, Homo Sapiens
QARAVVDIV

SEQ ID NO: 1382547 - protein, 9 aa, Homo Sapiens
PRPPPLVRC

SEQ ID NO: 1382548 - protein, 9 aa, Homo Sapiens
LPILCVFVT

SEQ ID NO: 1382549 - protein, 9 aa, Homo Sapiens
CSAPATVPG

SEQ ID NO: 1382550 - protein, 9 aa, Homo Sapiens
LAQSVQSHS

SEQ ID NO: 1382551 - protein, 9 aa, Homo Sapiens
EVPQQRLGE

SEQ ID NO: 1382552 - protein, 9 aa, Homo Sapiens
SSVVGLVTI

SEQ ID NO: 1382553 - protein, 9 aa, Homo Sapiens
TRTEGQASP

SEQ ID NO: 1382554 - protein, 9 aa, Homo Sapiens
LQPVCATTD

SEQ ID NO: 1382555 - protein, 9 aa, Homo Sapiens
APGTQVRAL

SEQ ID NO: 1382556 - protein, 9 aa, Homo Sapiens
SHSAVHGGV

SEQ ID NO: 1382557 - protein, 9 aa, Homo Sapiens
QLPGQKLSI

SEQ ID NO: 1382558 - protein, 9 aa, Homo Sapiens
VSGFLTALL

SEQ ID NO: 1382559 - protein, 9 aa, Homo Sapiens
SQARELPLQ

SEQ ID NO: 1382560 - protein, 9 aa, Homo Sapiens
TLYRDGMLE

SEQ ID NO: 1382561 - protein, 9 aa, Homo Sapiens
SACHGYCAG

SEQ ID NO: 1382562 - protein, 9 aa, Homo Sapiens
KLNDDNCQA

SEQ ID NO: 1382563 - protein, 9 aa, Homo Sapiens
AAVDAVRAR

SEQ ID NO: 1382564 - protein, 9 aa, Homo Sapiens
CKCCDYETA

SEQ ID NO: 1382565 - protein, 9 aa, Homo Sapiens
TEEEGKAAW

SEQ ID NO: 1382566 - protein, 9 aa, Homo Sapiens
YYQKCDWFF

SEQ ID NO: 1382567 - protein, 9 aa, Homo Sapiens
QRQARLGYE

SEQ ID NO: 1382568 - protein, 9 aa, Homo Sapiens
MNRRVCALM

SEQ ID NO: 1382569 - protein, 9 aa, Homo Sapiens
GGGGFGGGE

SEQ ID NO: 1382570 - protein, 9 aa, Homo Sapiens
ISTTSSERG

SEQ ID NO: 1382571 - protein, 9 aa, Homo Sapiens
SGVAFNLFM

SEQ ID NO: 1382572 - protein, 9 aa, Homo Sapiens
DPGCKWMDS

SEQ ID NO: 1382573 - protein, 9 aa, Homo Sapiens
RLSVVSNRQ

SEQ ID NO: 1382574 - protein, 9 aa, Homo Sapiens
GASPNLSEV

SEQ ID NO: 1382575 - protein, 9 aa, Homo Sapiens
DNNIENAFL

SEQ ID NO: 1382576 - protein, 9 aa, Homo Sapiens
GRCALLATG

SEQ ID NO: 1382577 - protein, 9 aa, Homo Sapiens
EQSNHTTNC

SEQ ID NO: 1382578 - protein, 9 aa, Homo Sapiens
PHTCPIRSE

SEQ ID NO: 1382579 - protein, 9 aa, Homo Sapiens
RTNHQVHSL

SEQ ID NO: 1382580 - protein, 9 aa, Homo Sapiens
KKKDSQNCE

SEQ ID NO: 1382581 - protein, 9 aa, Homo Sapiens
GTDFVAEYI

SEQ ID NO: 1382582 - protein, 9 aa, Homo Sapiens
EAVKEKSYC

SEQ ID NO: 1382583 - protein, 9 aa, Homo Sapiens
EGIFFIDHS

SEQ ID NO: 1382584 - protein, 9 aa, Homo Sapiens
VLPYQDPDG

SEQ ID NO: 1382585 - protein, 9 aa, Homo Sapiens
RDPRLNKVL

SEQ ID NO: 1382586 - protein, 9 aa, Homo Sapiens
KFRTWVERR

SEQ ID NO: 1382587 - protein, 9 aa, Homo Sapiens
ANSTWGCPF

SEQ ID NO: 1382588 - protein, 9 aa, Homo Sapiens
KNVADTLVL

SEQ ID NO: 1382589 - protein, 9 aa, Homo Sapiens
ILMLSMGGP

SEQ ID NO: 1382590 - protein, 9 aa, Homo Sapiens
PYVFMCPQG

SEQ ID NO: 1382591 - protein, 9 aa, Homo Sapiens
KKILFHYPH

SEQ ID NO: 1382592 - protein, 9 aa, Homo Sapiens
PVPGNPPSL

SEQ ID NO: 1382593 - protein, 9 aa, Homo Sapiens
SGLGPQRKP

SEQ ID NO: 1382594 - protein, 9 aa, Homo Sapiens
GSLQLTPPK

SEQ ID NO: 1382595 - protein, 9 aa, Homo Sapiens
SSQNSCSCS

SEQ ID NO: 1382596 - protein, 9 aa, Homo Sapiens
KGSPPPSQT

SEQ ID NO: 1382597 - protein, 9 aa, Homo Sapiens
LFFVLVNLE

SEQ ID NO: 1382598 - protein, 9 aa, Homo Sapiens
KITGDLEEM

SEQ ID NO: 1382599 - protein, 9 aa, Homo Sapiens
KWLRNGTEI

SEQ ID NO: 1382600 - protein, 9 aa, Homo Sapiens
EHSYLAQSV

SEQ ID NO: 1382601 - protein, 9 aa, Homo Sapiens
MKKRIPQDI

SEQ ID NO: 1382602 - protein, 9 aa, Homo Sapiens
LHACRHRNE

SEQ ID NO: 1382603 - protein, 9 aa, Homo Sapiens
RCFIFRRNE

SEQ ID NO: 1382604 - protein, 9 aa, Homo Sapiens
GANSTCWQG

SEQ ID NO: 1382605 - protein, 9 aa, Homo Sapiens
VKEKSYCQV

SEQ ID NO: 1382606 - protein, 9 aa, Homo Sapiens
LKLRDKRKC

SEQ ID NO: 1382607 - protein, 9 aa, Homo Sapiens
KDSQNCEDA

SEQ ID NO: 1382608 - protein, 9 aa, Homo Sapiens
LKVNPDDRL

SEQ ID NO: 1382609 - protein, 9 aa, Homo Sapiens
PTHPLLLPA

SEQ ID NO: 1382610 - protein, 9 aa, Homo Sapiens
YVLLCVSGT

SEQ ID NO: 1382611 - protein, 9 aa, Homo Sapiens
IRLGLKEFV

SEQ ID NO: 1382612 - protein, 9 aa, Homo Sapiens
FSDRLKLFG

SEQ ID NO: 1382613 - protein, 9 aa, Homo Sapiens
RKCFEIMNP

SEQ ID NO: 1382614 - protein, 9 aa, Homo Sapiens
IDREYKDHL

SEQ ID NO: 1382615 - protein, 9 aa, Homo Sapiens
PEGPAVQHC

SEQ ID NO: 1382616 - protein, 9 aa, Homo Sapiens
CIVSGFLTA

SEQ ID NO: 1382617 - protein, 9 aa, Homo Sapiens
IHPPEPGLW

SEQ ID NO: 1382618 - protein, 9 aa, Homo Sapiens
TETDAVDPR

SEQ ID NO: 1382619 - protein, 9 aa, Homo Sapiens
EELQENSST

SEQ ID NO: 1382620 - protein, 9 aa, Homo Sapiens
VWNAVEMLK

SEQ ID NO: 1382621 - protein, 9 aa, Homo Sapiens
KHLEFLGAA

SEQ ID NO: 1382622 - protein, 9 aa, Homo Sapiens
ADVQILHSR

SEQ ID NO: 1382623 - protein, 9 aa, Homo Sapiens
MGAPPAGVG

SEQ ID NO: 1382624 - protein, 9 aa, Homo Sapiens
KTVDGDVFR

SEQ ID NO: 1382625 - protein, 9 aa, Homo Sapiens
CWLVKRSRV

SEQ ID NO: 1382626 - protein, 9 aa, Homo Sapiens
IWCNIHFIT

SEQ ID NO: 1382627 - protein, 9 aa, Homo Sapiens
SVYSNVARQ

SEQ ID NO: 1382628 - protein, 9 aa, Homo Sapiens
PPECGPVVA

SEQ ID NO: 1382629 - protein, 9 aa, Homo Sapiens
EEIEMSATL

SEQ ID NO: 1382630 - protein, 9 aa, Homo Sapiens
KQISRSSQS

SEQ ID NO: 1382631 - protein, 9 aa, Homo Sapiens
GWTSLVQRD

SEQ ID NO: 1382632 - protein, 9 aa, Homo Sapiens
DEEGNLSME

SEQ ID NO: 1382633 - protein, 9 aa, Homo Sapiens
SHQSAPPIR

SEQ ID NO: 1382634 - protein, 9 aa, Homo Sapiens
SRYKIWCNI

SEQ ID NO: 1382635 - protein, 9 aa, Homo Sapiens
ASARACDSI

SEQ ID NO: 1382636 - protein, 9 aa, Homo Sapiens
PPSRSAADI

SEQ ID NO: 1382637 - protein, 9 aa, Homo Sapiens
LEGACGPKE

SEQ ID NO: 1382638 - protein, 9 aa, Homo Sapiens
HPELRKKLR

SEQ ID NO: 1382639 - protein, 9 aa, Homo Sapiens
LKHRLSVVS

SEQ ID NO: 1382640 - protein, 9 aa, Homo Sapiens
RCGTWTCSA

SEQ ID NO: 1382641 - protein, 9 aa, Homo Sapiens
EGPAVQHCN

SEQ ID NO: 1382642 - protein, 9 aa, Homo Sapiens
PPEPGDPDA

SEQ ID NO: 1382643 - protein, 9 aa, Homo Sapiens
QDHHNNSLP

SEQ ID NO: 1382644 - protein, 9 aa, Homo Sapiens
VLFIITNCC

SEQ ID NO: 1382645 - protein, 9 aa, Homo Sapiens
FIIGSYTIV

SEQ ID NO: 1382646 - protein, 9 aa, Homo Sapiens
VSPHIQRQV

SEQ ID NO: 1382647 - protein, 9 aa, Homo Sapiens
VSLPWIRSS

SEQ ID NO: 1382648 - protein, 9 aa, Homo Sapiens
QPTDPHRLG

SEQ ID NO: 1382649 - protein, 9 aa, Homo Sapiens
SVVGTPAYV

SEQ ID NO: 1382650 - protein, 9 aa, Homo Sapiens
HEHKKKHWE

SEQ ID NO: 1382651 - protein, 9 aa, Homo Sapiens
VNPDSKGEW

SEQ ID NO: 1382652 - protein, 9 aa, Homo Sapiens
SVTGVSELP

SEQ ID NO: 1382653 - protein, 9 aa, Homo Sapiens
RAAQQWPCC

SEQ ID NO: 1382654 - protein, 9 aa, Homo Sapiens
EVDYVPSLM

SEQ ID NO: 1382655 - protein, 9 aa, Homo Sapiens
SSSSEPLQI

SEQ ID NO: 1382656 - protein, 9 aa, Homo Sapiens
CKFCFSCNL

SEQ ID NO: 1382657 - protein, 9 aa, Homo Sapiens
EFESMGDHG

SEQ ID NO: 1382658 - protein, 9 aa, Homo Sapiens
LMAKGSQRY

SEQ ID NO: 1382659 - protein, 9 aa, Homo Sapiens
KKHTMPFWR

SEQ ID NO: 1382660 - protein, 9 aa, Homo Sapiens
GHGEVPEVS

SEQ ID NO: 1382661 - protein, 9 aa, Homo Sapiens
AAVGKARRR

SEQ ID NO: 1382662 - protein, 9 aa, Homo Sapiens
VVGTPAYVA

SEQ ID NO: 1382663 - protein, 9 aa, Homo Sapiens
FHEDYSRLY

SEQ ID NO: 1382664 - protein, 9 aa, Homo Sapiens
GNKKPASEG

SEQ ID NO: 1382665 - protein, 9 aa, Homo Sapiens
RKDDREREG

SEQ ID NO: 1382666 - protein, 9 aa, Homo Sapiens
IEDLLSIRC

SEQ ID NO: 1382667 - protein, 9 aa, Homo Sapiens
PCRDPRSSS

SEQ ID NO: 1382668 - protein, 9 aa, Homo Sapiens
PSKKQKKRE

SEQ ID NO: 1382669 - protein, 9 aa, Homo Sapiens
QSDYIPAQQ

SEQ ID NO: 1382670 - protein, 9 aa, Homo Sapiens
GASWAHASG

SEQ ID NO: 1382671 - protein, 9 aa, Homo Sapiens
YEEKKTGSV

SEQ ID NO: 1382672 - protein, 9 aa, Homo Sapiens
STNNAFSGV

SEQ ID NO: 1382673 - protein, 9 aa, Homo Sapiens
SPGPLEELQ

SEQ ID NO: 1382674 - protein, 9 aa, Homo Sapiens
SALYHGTID

SEQ ID NO: 1382675 - protein, 9 aa, Homo Sapiens
YAEQYPEFE

SEQ ID NO: 1382676 - protein, 9 aa, Homo Sapiens
VLVDIHLWQ

SEQ ID NO: 1382677 - protein, 9 aa, Homo Sapiens
PDQGPNKGF

SEQ ID NO: 1382678 - protein, 9 aa, Homo Sapiens
RQHNFTLAF

SEQ ID NO: 1382679 - protein, 9 aa, Homo Sapiens
TVQNSPKGC

SEQ ID NO: 1382680 - protein, 9 aa, Homo Sapiens
LAYSGFECW

SEQ ID NO: 1382681 - protein, 9 aa, Homo Sapiens
ATNPPQLKE

SEQ ID NO: 1382682 - protein, 9 aa, Homo Sapiens
WRKMQWDHC

SEQ ID NO: 1382683 - protein, 9 aa, Homo Sapiens
TVIVVSEPS

SEQ ID NO: 1382684 - protein, 9 aa, Homo Sapiens
AGTRTEGQA

SEQ ID NO: 1382685 - protein, 9 aa, Homo Sapiens
EFHAEKLAA

SEQ ID NO: 1382686 - protein, 9 aa, Homo Sapiens
KDDREREGK

SEQ ID NO: 1382687 - protein, 9 aa, Homo Sapiens
VVRPVATLS

SEQ ID NO: 1382688 - protein, 9 aa, Homo Sapiens
PKEQRKESG

SEQ ID NO: 1382689 - protein, 9 aa, Homo Sapiens
GFVVFTVLG

SEQ ID NO: 1382690 - protein, 9 aa, Homo Sapiens
CKKLQKKKN

SEQ ID NO: 1382691 - protein, 9 aa, Homo Sapiens
FRHVIWKGI

SEQ ID NO: 1382692 - protein, 9 aa, Homo Sapiens
KTVQCYWRL

SEQ ID NO: 1382693 - protein, 9 aa, Homo Sapiens
FDSIIIILS

SEQ ID NO: 1382694 - protein, 9 aa, Homo Sapiens
RRTCYHPTI

SEQ ID NO: 1382695 - protein, 9 aa, Homo Sapiens
GTRTEGQAS

SEQ ID NO: 1382696 - protein, 9 aa, Homo Sapiens
RPSCCSTPC

SEQ ID NO: 1382697 - protein, 9 aa, Homo Sapiens
PFPVRRAIQ

SEQ ID NO: 1382698 - protein, 9 aa, Homo Sapiens
DSLALHLQA

SEQ ID NO: 1382699 - protein, 9 aa, Homo Sapiens
RFFLQFRFY

SEQ ID NO: 1382700 - protein, 9 aa, Homo Sapiens
VDNNQGGPR

SEQ ID NO: 1382701 - protein, 9 aa, Homo Sapiens
SVLVSPEAI

SEQ ID NO: 1382702 - protein, 9 aa, Homo Sapiens
WNCPSKKTK

SEQ ID NO: 1382703 - protein, 9 aa, Homo Sapiens
TVSRYKIWC

SEQ ID NO: 1382704 - protein, 9 aa, Homo Sapiens
KKPKEQEKE

SEQ ID NO: 1382705 - protein, 9 aa, Homo Sapiens
VRALFETCS

SEQ ID NO: 1382706 - protein, 9 aa, Homo Sapiens
VRKEHEIRM

SEQ ID NO: 1382707 - protein, 9 aa, Homo Sapiens
LQENSSTPK

SEQ ID NO: 1382708 - protein, 9 aa, Homo Sapiens
RIPKPQVIN

SEQ ID NO: 1382709 - protein, 9 aa, Homo Sapiens
GEHVPSSPF

SEQ ID NO: 1382710 - protein, 9 aa, Homo Sapiens
RWGQPFRLC

SEQ ID NO: 1382711 - protein, 9 aa, Homo Sapiens
MCDCFSDSG

SEQ ID NO: 1382712 - protein, 9 aa, Homo Sapiens
QAVNMMCQH

SEQ ID NO: 1382713 - protein, 9 aa, Homo Sapiens
GPEVPDSLA

SEQ ID NO: 1382714 - protein, 9 aa, Homo Sapiens
QENICQIFS

SEQ ID NO: 1382715 - protein, 9 aa, Homo Sapiens
TASREDWGG

SEQ ID NO: 1382716 - protein, 9 aa, Homo Sapiens
AVQELLPNC

SEQ ID NO: 1382717 - protein, 9 aa, Homo Sapiens
FPLNSTETS

SEQ ID NO: 1382718 - protein, 9 aa, Homo Sapiens
RCHRHKPWR

SEQ ID NO: 1382719 - protein, 9 aa, Homo Sapiens
RHQRNAAPR

SEQ ID NO: 1382720 - protein, 9 aa, Homo Sapiens
KSLSVLVSP

SEQ ID NO: 1382721 - protein, 9 aa, Homo Sapiens
KGKSQLSLS

SEQ ID NO: 1382722 - protein, 9 aa, Homo Sapiens
VPSPCRNGG

SEQ ID NO: 1382723 - protein, 9 aa, Homo Sapiens
GAVLQHGDE

SEQ ID NO: 1382724 - protein, 9 aa, Homo Sapiens
CQAFIKFLS

SEQ ID NO: 1382725 - protein, 9 aa, Homo Sapiens
LLNDSNITV

SEQ ID NO: 1382726 - protein, 9 aa, Homo Sapiens
FEEDPGCKW

SEQ ID NO: 1382727 - protein, 9 aa, Homo Sapiens
EIYFLSTNN

SEQ ID NO: 1382728 - protein, 9 aa, Homo Sapiens
WSWAGRPWE

SEQ ID NO: 1382729 - protein, 9 aa, Homo Sapiens
IQVLPAPSR

SEQ ID NO: 1382730 - protein, 9 aa, Homo Sapiens
WKAKRQEAV

SEQ ID NO: 1382731 - protein, 9 aa, Homo Sapiens
DSNITVLGG

SEQ ID NO: 1382732 - protein, 9 aa, Homo Sapiens
HTGEKPYKW

SEQ ID NO: 1382733 - protein, 9 aa, Homo Sapiens
FIPRRAKTA

SEQ ID NO: 1382734 - protein, 9 aa, Homo Sapiens
SSTPKREKA

SEQ ID NO: 1382735 - protein, 9 aa, Homo Sapiens
VIWKGILDH

SEQ ID NO: 1382736 - protein, 9 aa, Homo Sapiens
FIVDQHDTD

SEQ ID NO: 1382737 - protein, 9 aa, Homo Sapiens
QKKIQDVSM

SEQ ID NO: 1382738 - protein, 9 aa, Homo Sapiens
PPSQTARAP

SEQ ID NO: 1382739 - protein, 9 aa, Homo Sapiens
LKEELQENS

SEQ ID NO: 1382740 - protein, 9 aa, Homo Sapiens
WIAITKCCG

SEQ ID NO: 1382741 - protein, 9 aa, Homo Sapiens
VILVSLPWI

SEQ ID NO: 1382742 - protein, 9 aa, Homo Sapiens
ETDRGGARA

SEQ ID NO: 1382743 - protein, 9 aa, Homo Sapiens
AGDGFSFEE

SEQ ID NO: 1382744 - protein, 9 aa, Homo Sapiens
PQRKPLRRV

SEQ ID NO: 1382745 - protein, 9 aa, Homo Sapiens
TGSNEVTTR

SEQ ID NO: 1382746 - protein, 9 aa, Homo Sapiens
IEETGFHHV

SEQ ID NO: 1382747 - protein, 9 aa, Homo Sapiens
TPGVHEGCA

SEQ ID NO: 1382748 - protein, 9 aa, Homo Sapiens
KTAVRRAAQ

SEQ ID NO: 1382749 - protein, 9 aa, Homo Sapiens
LLLWPAVPV

SEQ ID NO: 1382750 - protein, 9 aa, Homo Sapiens
PLWDKIAME

SEQ ID NO: 1382751 - protein, 9 aa, Homo Sapiens
IILSLMELG

SEQ ID NO: 1382752 - protein, 9 aa, Homo Sapiens
TNVFVPQRP

SEQ ID NO: 1382753 - protein, 9 aa, Homo Sapiens
GRGRPCGRP

SEQ ID NO: 1382754 - protein, 9 aa, Homo Sapiens
ISRNNIRKN

SEQ ID NO: 1382755 - protein, 9 aa, Homo Sapiens
DTAGHQRPF

SEQ ID NO: 1382756 - protein, 9 aa, Homo Sapiens
SHSNHGSLR

SEQ ID NO: 1382757 - protein, 9 aa, Homo Sapiens
PGSVPGKEG

SEQ ID NO: 1382758 - protein, 9 aa, Homo Sapiens
TPRLEKLWN

SEQ ID NO: 1382759 - protein, 9 aa, Homo Sapiens
LVLKLLGRG

SEQ ID NO: 1382760 - protein, 9 aa, Homo Sapiens
GSGRLFILC

SEQ ID NO: 1382761 - protein, 9 aa, Homo Sapiens
PTSPDSLRK

SEQ ID NO: 1382762 - protein, 9 aa, Homo Sapiens
SCDYGSGRL

SEQ ID NO: 1382763 - protein, 9 aa, Homo Sapiens
LFLLLIDLS

SEQ ID NO: 1382764 - protein, 9 aa, Homo Sapiens
IEGIDREYK

SEQ ID NO: 1382765 - protein, 9 aa, Homo Sapiens
ILVSLPWIR

SEQ ID NO: 1382766 - protein, 9 aa, Homo Sapiens
RGHGEVPEV

SEQ ID NO: 1382767 - protein, 9 aa, Homo Sapiens
NTVTPCQQN

SEQ ID NO: 1382768 - protein, 9 aa, Homo Sapiens
EEDPGCKWM

SEQ ID NO: 1382769 - protein, 9 aa, Homo Sapiens
DIALVMQTE

SEQ ID NO: 1382770 - protein, 9 aa, Homo Sapiens
QATSVEVTV

SEQ ID NO: 1382771 - protein, 9 aa, Homo Sapiens
RILLSLLCR

SEQ ID NO: 1382772 - protein, 9 aa, Homo Sapiens
SIFNCSIRR

SEQ ID NO: 1382773 - protein, 9 aa, Homo Sapiens
ANARLTATR

SEQ ID NO: 1382774 - protein, 9 aa, Homo Sapiens
SKVQSHAVK

SEQ ID NO: 1382775 - protein, 9 aa, Homo Sapiens
LHGKKCAVS

SEQ ID NO: 1382776 - protein, 9 aa, Homo Sapiens
PTCVTSCCR

SEQ ID NO: 1382777 - protein, 9 aa, Homo Sapiens
PPESKQKGL

SEQ ID NO: 1382778 - protein, 9 aa, Homo Sapiens
WGADAYQSV

SEQ ID NO: 1382779 - protein, 9 aa, Homo Sapiens
DGEVEDEVL

SEQ ID NO: 1382780 - protein, 9 aa, Homo Sapiens
GGRHLPLLT

SEQ ID NO: 1382781 - protein, 9 aa, Homo Sapiens
DTLEGACGP

SEQ ID NO: 1382782 - protein, 9 aa, Homo Sapiens
RSQSQIIEN

SEQ ID NO: 1382783 - protein, 9 aa, Homo Sapiens
SLSAPLPIL

SEQ ID NO: 1382784 - protein, 9 aa, Homo Sapiens
GPLEELQTE

SEQ ID NO: 1382785 - protein, 9 aa, Homo Sapiens
SGHFAQDCK

SEQ ID NO: 1382786 - protein, 9 aa, Homo Sapiens
RARNREYFR

SEQ ID NO: 1382787 - protein, 9 aa, Homo Sapiens
SQFPLNSTE

SEQ ID NO: 1382788 - protein, 9 aa, Homo Sapiens
VPQLQLVTS

SEQ ID NO: 1382789 - protein, 9 aa, Homo Sapiens
EVGKCLADG

SEQ ID NO: 1382790 - protein, 9 aa, Homo Sapiens
NTPGISQYL

SEQ ID NO: 1382791 - protein, 9 aa, Homo Sapiens
GACGPKEDA

SEQ ID NO: 1382792 - protein, 9 aa, Homo Sapiens
MSSPPSRSA

SEQ ID NO: 1382793 - protein, 9 aa, Homo Sapiens
AINFAKGEL

SEQ ID NO: 1382794 - protein, 9 aa, Homo Sapiens
ASKDEGLKA

SEQ ID NO: 1382795 - protein, 9 aa, Homo Sapiens
SLFNTVTPC

SEQ ID NO: 1382796 - protein, 9 aa, Homo Sapiens
PLPILCVFV

SEQ ID NO: 1382797 - protein, 9 aa, Homo Sapiens
VPQRPQTDE

SEQ ID NO: 1382798 - protein, 9 aa, Homo Sapiens
SLSLLLWPA

SEQ ID NO: 1382799 - protein, 9 aa, Homo Sapiens
CLEQQCELR

SEQ ID NO: 1382800 - protein, 9 aa, Homo Sapiens
ASREDWGGP

SEQ ID NO: 1382801 - protein, 9 aa, Homo Sapiens
AALPLNSLH

SEQ ID NO: 1382802 - protein, 9 aa, Homo Sapiens
FTPTSVITS

SEQ ID NO: 1382803 - protein, 9 aa, Homo Sapiens
SSHMGAPPA

SEQ ID NO: 1382804 - protein, 9 aa, Homo Sapiens
ECFEEDPGC

SEQ ID NO: 1382805 - protein, 9 aa, Homo Sapiens
ACHGYCAGH

SEQ ID NO: 1382806 - protein, 9 aa, Homo Sapiens
VDYVPSLMA

SEQ ID NO: 1382807 - protein, 9 aa, Homo Sapiens
IPGDGATVP

SEQ ID NO: 1382808 - protein, 9 aa, Homo Sapiens
DEAAWTGAS

SEQ ID NO: 1382809 - protein, 9 aa, Homo Sapiens
KLRDKRKCF

SEQ ID NO: 1382810 - protein, 9 aa, Homo Sapiens
WTPADQRRP

SEQ ID NO: 1382811 - protein, 9 aa, Homo Sapiens
ASDLCQRST

SEQ ID NO: 1382812 - protein, 9 aa, Homo Sapiens
RQAVNMMCQ

SEQ ID NO: 1382813 - protein, 9 aa, Homo Sapiens
RGRARGSKD

SEQ ID NO: 1382814 - protein, 9 aa, Homo Sapiens
SSDCNIYDS

SEQ ID NO: 1382815 - protein, 9 aa, Homo Sapiens
CDCFSDSGV

SEQ ID NO: 1382816 - protein, 9 aa, Homo Sapiens
EALASKRFC

SEQ ID NO: 1382817 - protein, 9 aa, Homo Sapiens
AALHPGLAV

SEQ ID NO: 1382818 - protein, 9 aa, Homo Sapiens
SNMIEPGQC

SEQ ID NO: 1382819 - protein, 9 aa, Homo Sapiens
KKFRTWVER

SEQ ID NO: 1382820 - protein, 9 aa, Homo Sapiens
APKHARTFV

SEQ ID NO: 1382821 - protein, 9 aa, Homo Sapiens
HTDKGGFFC

SEQ ID NO: 1382822 - protein, 9 aa, Homo Sapiens
KSRGSVHPD

SEQ ID NO: 1382823 - protein, 9 aa, Homo Sapiens
LRDGGDHGV

SEQ ID NO: 1382824 - protein, 9 aa, Homo Sapiens
RDGGDHGVW

SEQ ID NO: 1382825 - protein, 9 aa, Homo Sapiens
EQQHPAGTR

SEQ ID NO: 1382826 - protein, 9 aa, Homo Sapiens
TPAYVAPEV

SEQ ID NO: 1382827 - protein, 9 aa, Homo Sapiens
QERRLPGAG

SEQ ID NO: 1382828 - protein, 9 aa, Homo Sapiens
PHIPGDGAT

SEQ ID NO: 1382829 - protein, 9 aa, Homo Sapiens
VTTRYEEKK

SEQ ID NO: 1382830 - protein, 9 aa, Homo Sapiens
KLLSQFPLN

SEQ ID NO: 1382831 - protein, 9 aa, Homo Sapiens
CAVPDTAWL

SEQ ID NO: 1382832 - protein, 9 aa, Homo Sapiens
KAFSQNIHL

SEQ ID NO: 1382833 - protein, 9 aa, Homo Sapiens
RTATTNRAG

SEQ ID NO: 1382834 - protein, 9 aa, Homo Sapiens
RYTSMMSGG

SEQ ID NO: 1382835 - protein, 9 aa, Homo Sapiens
GSREVVGEG

SEQ ID NO: 1382836 - protein, 9 aa, Homo Sapiens
DPGSPPECG

SEQ ID NO: 1382837 - protein, 9 aa, Homo Sapiens
AAVKTCRWQ

SEQ ID NO: 1382838 - protein, 9 aa, Homo Sapiens
PGPLEELQT

SEQ ID NO: 1382839 - protein, 9 aa, Homo Sapiens
IRSICQQNS

SEQ ID NO: 1382840 - protein, 9 aa, Homo Sapiens
LSLLLWPAV

SEQ ID NO: 1382841 - protein, 9 aa, Homo Sapiens
VPHACCGLC

SEQ ID NO: 1382842 - protein, 9 aa, Homo Sapiens
SHFWIQDKG

SEQ ID NO: 1382843 - protein, 9 aa, Homo Sapiens
ATMFSIGCA

SEQ ID NO: 1382844 - protein, 9 aa, Homo Sapiens
EETRCFIFR

SEQ ID NO: 1382845 - protein, 9 aa, Homo Sapiens
PRSWTRTCP

SEQ ID NO: 1382846 - protein, 9 aa, Homo Sapiens
GFDLCVVCG

SEQ ID NO: 1382847 - protein, 9 aa, Homo Sapiens
PVIRKSRGT

SEQ ID NO: 1382848 - protein, 9 aa, Homo Sapiens
VKPFILTRD

SEQ ID NO: 1382849 - protein, 9 aa, Homo Sapiens
TGSREVVGE

SEQ ID NO: 1382850 - protein, 9 aa, Homo Sapiens
FAKVSQDHH

SEQ ID NO: 1382851 - protein, 9 aa, Homo Sapiens
NKNTPSTAG

SEQ ID NO: 1382852 - protein, 9 aa, Homo Sapiens
PDSLRKHKD

SEQ ID NO: 1382853 - protein, 9 aa, Homo Sapiens
KVCAVPDTA

SEQ ID NO: 1382854 - protein, 9 aa, Homo Sapiens
VPRAALAPA

SEQ ID NO: 1382855 - protein, 9 aa, Homo Sapiens
ATPITPASG

SEQ ID NO: 1382856 - protein, 9 aa, Homo Sapiens
TNQGKKYYQ

SEQ ID NO: 1382857 - protein, 9 aa, Homo Sapiens
LSLLCRYYP

SEQ ID NO: 1382858 - protein, 9 aa, Homo Sapiens
VALDHRKAS

SEQ ID NO: 1382859 - protein, 9 aa, Homo Sapiens
PAVCPRHPL

SEQ ID NO: 1382860 - protein, 9 aa, Homo Sapiens
RKQYDAYGP

SEQ ID NO: 1382861 - protein, 9 aa, Homo Sapiens
ADMVYVAQS

SEQ ID NO: 1382862 - protein, 9 aa, Homo Sapiens
LPNCIPHKL

SEQ ID NO: 1382863 - protein, 9 aa, Homo Sapiens
AVVDIVKRY

SEQ ID NO: 1382864 - protein, 9 aa, Homo Sapiens
SKCLCHSYC

SEQ ID NO: 1382865 - protein, 9 aa, Homo Sapiens
MNPKSFIYS

SEQ ID NO: 1382866 - protein, 9 aa, Homo Sapiens
PLNSLHTVR

SEQ ID NO: 1382867 - protein, 9 aa, Homo Sapiens
GQEVGLLPR

SEQ ID NO: 1382868 - protein, 9 aa, Homo Sapiens
KNLIWQVFL

SEQ ID NO: 1382869 - protein, 9 aa, Homo Sapiens
PFPAKVQGQ

SEQ ID NO: 1382870 - protein, 9 aa, Homo Sapiens
QGKKYYQKC

SEQ ID NO: 1382871 - protein, 9 aa, Homo Sapiens
WGQPFRLCH

SEQ ID NO: 1382872 - protein, 9 aa, Homo Sapiens
YTCAGTNMV

SEQ ID NO: 1382873 - protein, 9 aa, Homo Sapiens
AYDISVVVT

SEQ ID NO: 1382874 - protein, 9 aa, Homo Sapiens
KFHYDNTPG

SEQ ID NO: 1382875 - protein, 9 aa, Homo Sapiens
HGSLRQISG

SEQ ID NO: 1382876 - protein, 9 aa, Homo Sapiens
DAVRARALS

SEQ ID NO: 1382877 - protein, 9 aa, Homo Sapiens
QHGPLTGWA

SEQ ID NO: 1382878 - protein, 9 aa, Homo Sapiens
DVLFQVSPH

SEQ ID NO: 1382879 - protein, 9 aa, Homo Sapiens
QNCISLSET

SEQ ID NO: 1382880 - protein, 9 aa, Homo Sapiens
AASGVAAVT

SEQ ID NO: 1382881 - protein, 9 aa, Homo Sapiens
VPARLRHLL

SEQ ID NO: 1382882 - protein, 9 aa, Homo Sapiens
CRCESTIVD

SEQ ID NO: 1382883 - protein, 9 aa, Homo Sapiens
SDAGMYTCA

SEQ ID NO: 1382884 - protein, 9 aa, Homo Sapiens
VKRSRVELL

SEQ ID NO: 1382885 - protein, 9 aa, Homo Sapiens
KRTACAQKK

SEQ ID NO: 1382886 - protein, 9 aa, Homo Sapiens
PLRRGPQGG

SEQ ID NO: 1382887 - protein, 9 aa, Homo Sapiens
PEPGLWREQ

SEQ ID NO: 1382888 - protein, 9 aa, Homo Sapiens
LFIFLLVAY

SEQ ID NO: 1382889 - protein, 9 aa, Homo Sapiens
LHRIIGAVR

SEQ ID NO: 1382890 - protein, 9 aa, Homo Sapiens
DTHVDEDLK

SEQ ID NO: 1382891 - protein, 9 aa, Homo Sapiens
DIVTGGVSP

SEQ ID NO: 1382892 - protein, 9 aa, Homo Sapiens
AYSAATAAG

SEQ ID NO: 1382893 - protein, 9 aa, Homo Sapiens
DAYGPAGFD

SEQ ID NO: 1382894 - protein, 9 aa, Homo Sapiens
HAISLSGPR

SEQ ID NO: 1382895 - protein, 9 aa, Homo Sapiens
INAGTVHLG

SEQ ID NO: 1382896 - protein, 9 aa, Homo Sapiens
ETHEHKKKH

SEQ ID NO: 1382897 - protein, 9 aa, Homo Sapiens
EGQASPPAA

SEQ ID NO: 1382898 - protein, 9 aa, Homo Sapiens
IVADHLGLG

SEQ ID NO: 1382899 - protein, 9 aa, Homo Sapiens
YSKCLCHSY

SEQ ID NO: 1382900 - protein, 9 aa, Homo Sapiens
NEVTTRYEE

SEQ ID NO: 1382901 - protein, 9 aa, Homo Sapiens
LHHLEALQL

SEQ ID NO: 1382902 - protein, 9 aa, Homo Sapiens
MHKCKCCDY

SEQ ID NO: 1382903 - protein, 9 aa, Homo Sapiens
FTKLAKKNR

SEQ ID NO: 1382904 - protein, 9 aa, Homo Sapiens
GRRGQDLAF

SEQ ID NO: 1382905 - protein, 9 aa, Homo Sapiens
TMNRRVCAL

SEQ ID NO: 1382906 - protein, 9 aa, Homo Sapiens
SHVCSRTPV

SEQ ID NO: 1382907 - protein, 9 aa, Homo Sapiens
YKVCTIRYV

SEQ ID NO: 1382908 - protein, 9 aa, Homo Sapiens
SKKQTGKKR

SEQ ID NO: 1382909 - protein, 9 aa, Homo Sapiens
GIFFIDHSP

SEQ ID NO: 1382910 - protein, 9 aa, Homo Sapiens
WSHFDSLYF

SEQ ID NO: 1382911 - protein, 9 aa, Homo Sapiens
VWSLPAEPC

SEQ ID NO: 1382912 - protein, 9 aa, Homo Sapiens
APGTLPKAG

SEQ ID NO: 1382913 - protein, 9 aa, Homo Sapiens
NSLFNTVTP

SEQ ID NO: 1382914 - protein, 9 aa, Homo Sapiens
DTYGYSTPT

SEQ ID NO: 1382915 - protein, 9 aa, Homo Sapiens
LSVVSNRQV

SEQ ID NO: 1382916 - protein, 9 aa, Homo Sapiens
RTHERERDF

SEQ ID NO: 1382917 - protein, 9 aa, Homo Sapiens
KRKCFEIMN

SEQ ID NO: 1382918 - protein, 9 aa, Homo Sapiens
KGELRYYFL

SEQ ID NO: 1382919 - protein, 9 aa, Homo Sapiens
QRSAPGTLP

SEQ ID NO: 1382920 - protein, 9 aa, Homo Sapiens
PPMDSSYTK

SEQ ID NO: 1382921 - protein, 9 aa, Homo Sapiens
MTVTTSGFS

SEQ ID NO: 1382922 - protein, 9 aa, Homo Sapiens
REDWGGPEV

SEQ ID NO: 1382923 - protein, 9 aa, Homo Sapiens
LSVLVSPEA

SEQ ID NO: 1382924 - protein, 9 aa, Homo Sapiens
IPEQFRHVI

SEQ ID NO: 1382925 - protein, 9 aa, Homo Sapiens
QGAKKHTMP

SEQ ID NO: 1382926 - protein, 9 aa, Homo Sapiens
PHFWKDFLA

SEQ ID NO: 1382927 - protein, 9 aa, Homo Sapiens
TAAVADPHS

SEQ ID NO: 1382928 - protein, 9 aa, Homo Sapiens
GQDLAFQQH

SEQ ID NO: 1382929 - protein, 9 aa, Homo Sapiens
IKAFHEDYS

SEQ ID NO: 1382930 - protein, 9 aa, Homo Sapiens
FECEVVNPD

SEQ ID NO: 1382931 - protein, 9 aa, Homo Sapiens
LGAEKITGD

SEQ ID NO: 1382932 - protein, 9 aa, Homo Sapiens
RNVRTATTN

SEQ ID NO: 1382933 - protein, 9 aa, Homo Sapiens
PATVPGLWM

SEQ ID NO: 1382934 - protein, 9 aa, Homo Sapiens
PGLDQLDRQ

SEQ ID NO: 1382935 - protein, 9 aa, Homo Sapiens
SQNIHLIVH

SEQ ID NO: 1382936 - protein, 9 aa, Homo Sapiens
MMSGGRCAL

SEQ ID NO: 1382937 - protein, 9 aa, Homo Sapiens
YVKASEAGD

SEQ ID NO: 1382938 - protein, 9 aa, Homo Sapiens
APLTYDNYM

SEQ ID NO: 1382939 - protein, 9 aa, Homo Sapiens
SWSPASGSG

SEQ ID NO: 1382940 - protein, 9 aa, Homo Sapiens
TTVNSPGPL

SEQ ID NO: 1382941 - protein, 9 aa, Homo Sapiens
HNSWDSPAF

SEQ ID NO: 1382942 - protein, 9 aa, Homo Sapiens
KTGSVRKAN

SEQ ID NO: 1382943 - protein, 9 aa, Homo Sapiens
EHEIRMQLH

SEQ ID NO: 1382944 - protein, 9 aa, Homo Sapiens
SPVQRQREW

SEQ ID NO: 1382945 - protein, 9 aa, Homo Sapiens
RKIIFLTEG

SEQ ID NO: 1382946 - protein, 9 aa, Homo Sapiens
CEVVNPDSK

SEQ ID NO: 1382947 - protein, 9 aa, Homo Sapiens
NEPRMRSSK

SEQ ID NO: 1382948 - protein, 9 aa, Homo Sapiens
KIQDVSMKF

SEQ ID NO: 1382949 - protein, 9 aa, Homo Sapiens
LRVLYQIEK

SEQ ID NO: 1382950 - protein, 9 aa, Homo Sapiens
PTIVCLPGC

SEQ ID NO: 1382951 - protein, 9 aa, Homo Sapiens
GRRGWRPLR

SEQ ID NO: 1382952 - protein, 9 aa, Homo Sapiens
SNSLFNTVT

SEQ ID NO: 1382953 - protein, 9 aa, Homo Sapiens
AHKDFKKGS

SEQ ID NO: 1382954 - protein, 9 aa, Homo Sapiens
GAMAQHESS

SEQ ID NO: 1382955 - protein, 9 aa, Homo Sapiens
WLLQIAQEL

SEQ ID NO: 1382956 - protein, 9 aa, Homo Sapiens
RDPNTPVIR

SEQ ID NO: 1382957 - protein, 9 aa, Homo Sapiens
GAKKHTMPF

SEQ ID NO: 1382958 - protein, 9 aa, Homo Sapiens
KMRHNHLIK

SEQ ID NO: 1382959 - protein, 9 aa, Homo Sapiens
YPHFWKDFL

SEQ ID NO: 1382960 - protein, 9 aa, Homo Sapiens
YKIWCNIHF

SEQ ID NO: 1382961 - protein, 9 aa, Homo Sapiens
GQQERRDPG

SEQ ID NO: 1382962 - protein, 9 aa, Homo Sapiens
PGQCFCRFD

SEQ ID NO: 1382963 - protein, 9 aa, Homo Sapiens
RAWREDLTI

SEQ ID NO: 1382964 - protein, 9 aa, Homo Sapiens
QLLNYVISS

SEQ ID NO: 1382965 - protein, 9 aa, Homo Sapiens
AKVPPQEGP

SEQ ID NO: 1382966 - protein, 9 aa, Homo Sapiens
SYCQVRLNE

SEQ ID NO: 1382967 - protein, 9 aa, Homo Sapiens
QRHQRNAAP

SEQ ID NO: 1382968 - protein, 9 aa, Homo Sapiens
MMWMGGKTP

SEQ ID NO: 1382969 - protein, 9 aa, Homo Sapiens
RFRSMSPIP

SEQ ID NO: 1382970 - protein, 9 aa, Homo Sapiens
AIALFTSAL

SEQ ID NO: 1382971 - protein, 9 aa, Homo Sapiens
PPPYVFMCP

SEQ ID NO: 1382972 - protein, 9 aa, Homo Sapiens
LPGSVPGKE

SEQ ID NO: 1382973 - protein, 9 aa, Homo Sapiens
SEMKQLIGN

SEQ ID NO: 1382974 - protein, 9 aa, Homo Sapiens
WNFELERGD

SEQ ID NO: 1382975 - protein, 9 aa, Homo Sapiens
LLVPHACCG

SEQ ID NO: 1382976 - protein, 9 aa, Homo Sapiens
CNIHFITWR

SEQ ID NO: 1382977 - protein, 9 aa, Homo Sapiens
KTGLRCGTW

SEQ ID NO: 1382978 - protein, 9 aa, Homo Sapiens
PATPITPAS

SEQ ID NO: 1382979 - protein, 9 aa, Homo Sapiens
GPAGFDPGA

SEQ ID NO: 1382980 - protein, 9 aa, Homo Sapiens
FVCVLGRIG

SEQ ID NO: 1382981 - protein, 9 aa, Homo Sapiens
QRRTVTCQI

SEQ ID NO: 1382982 - protein, 9 aa, Homo Sapiens
RTWVERRQF

SEQ ID NO: 1382983 - protein, 9 aa, Homo Sapiens
QIEKYIMTC

SEQ ID NO: 1382984 - protein, 9 aa, Homo Sapiens
HVCSRTPVE

SEQ ID NO: 1382985 - protein, 9 aa, Homo Sapiens
ANLTNQGKK

SEQ ID NO: 1382986 - protein, 9 aa, Homo Sapiens
LHYQAAWRK

SEQ ID NO: 1382987 - protein, 9 aa, Homo Sapiens
LKGWGGDCP

SEQ ID NO: 1382988 - protein, 9 aa, Homo Sapiens
LIWQVFLKM

SEQ ID NO: 1382989 - protein, 9 aa, Homo Sapiens
GEVEDEVLL

SEQ ID NO: 1382990 - protein, 9 aa, Homo Sapiens
VVAGRGPAA

SEQ ID NO: 1382991 - protein, 9 aa, Homo Sapiens
SYHSKHLKT

SEQ ID NO: 1382992 - protein, 9 aa, Homo Sapiens
AATAAGISQ

SEQ ID NO: 1382993 - protein, 9 aa, Homo Sapiens
IETDRGGAR

SEQ ID NO: 1382994 - protein, 9 aa, Homo Sapiens
VTIRSICQQ

SEQ ID NO: 1382995 - protein, 9 aa, Homo Sapiens
WGGPEVPDS

SEQ ID NO: 1382996 - protein, 9 aa, Homo Sapiens
SITSNVLPL

SEQ ID NO: 1382997 - protein, 9 aa, Homo Sapiens
TELQNHTLT

SEQ ID NO: 1382998 - protein, 9 aa, Homo Sapiens
STWGCPFHD

SEQ ID NO: 1382999 - protein, 9 aa, Homo Sapiens
QRKSEVQVT

SEQ ID NO: 1383000 - protein, 9 aa, Homo Sapiens
APGQEETVH

SEQ ID NO: 1383001 - protein, 9 aa, Homo Sapiens
ATGWDSRCA

SEQ ID NO: 1383002 - protein, 9 aa, Homo Sapiens
PNTPVIRKS

SEQ ID NO: 1383003 - protein, 9 aa, Homo Sapiens
FFCERIPKP

SEQ ID NO: 1383004 - protein, 9 aa, Homo Sapiens
GPVVAGRGP

SEQ ID NO: 1383005 - protein, 9 aa, Homo Sapiens
EHCSEVSEI

SEQ ID NO: 1383006 - protein, 9 aa, Homo Sapiens
CYHPTIVCL

SEQ ID NO: 1383007 - protein, 9 aa, Homo Sapiens
LGPQRKPLR

SEQ ID NO: 1383008 - protein, 9 aa, Homo Sapiens
FQVSPHIQR

SEQ ID NO: 1383009 - protein, 9 aa, Homo Sapiens
KLERERMEQ

SEQ ID NO: 1383010 - protein, 9 aa, Homo Sapiens
SLVQRDRLE

SEQ ID NO: 1383011 - protein, 9 aa, Homo Sapiens
HCRPPDQKI

SEQ ID NO: 1383012 - protein, 9 aa, Homo Sapiens
LERKIIFLT

SEQ ID NO: 1383013 - protein, 9 aa, Homo Sapiens
TCTVSRYKI

SEQ ID NO: 1383014 - protein, 9 aa, Homo Sapiens
SDCNIYDSA

SEQ ID NO: 1383015 - protein, 9 aa, Homo Sapiens
SATNPPQLK

SEQ ID NO: 1383016 - protein, 9 aa, Homo Sapiens
HMGAPPAGV

SEQ ID NO: 1383017 - protein, 9 aa, Homo Sapiens
HEIRMQLHM

SEQ ID NO: 1383018 - protein, 9 aa, Homo Sapiens
HPAGTRTEG

SEQ ID NO: 1383019 - protein, 9 aa, Homo Sapiens
KTRAYKVCT

SEQ ID NO: 1383020 - protein, 9 aa, Homo Sapiens
GDLEVAQEN

SEQ ID NO: 1383021 - protein, 9 aa, Homo Sapiens
KGGKCQEGK

SEQ ID NO: 1383022 - protein, 9 aa, Homo Sapiens
AEQYPEFES

SEQ ID NO: 1383023 - protein, 9 aa, Homo Sapiens
HDTDEKYNF

SEQ ID NO: 1383024 - protein, 9 aa, Homo Sapiens
ENAFLSGSN

SEQ ID NO: 1383025 - protein, 9 aa, Homo Sapiens
SDHLSINPV

SEQ ID NO: 1383026 - protein, 9 aa, Homo Sapiens
GTLPKAGAA

SEQ ID NO: 1383027 - protein, 9 aa, Homo Sapiens
SRQEVRGSH

SEQ ID NO: 1383028 - protein, 9 aa, Homo Sapiens
AISLSGPRM

SEQ ID NO: 1383029 - protein, 9 aa, Homo Sapiens
LPKKKKEAY

SEQ ID NO: 1383030 - protein, 9 aa, Homo Sapiens
PRSQSQIIE

SEQ ID NO: 1383031 - protein, 9 aa, Homo Sapiens
TRMGTPRLE

SEQ ID NO: 1383032 - protein, 9 aa, Homo Sapiens
VCTIRYVAL

SEQ ID NO: 1383033 - protein, 9 aa, Homo Sapiens
DPHTCPIRS

SEQ ID NO: 1383034 - protein, 9 aa, Homo Sapiens
RVCALMLLA

SEQ ID NO: 1383035 - protein, 9 aa, Homo Sapiens
PVSQQNKNT

SEQ ID NO: 1383036 - protein, 9 aa, Homo Sapiens
KILFHYPHF

SEQ ID NO: 1383037 - protein, 9 aa, Homo Sapiens
TGLPGSVPG

SEQ ID NO: 1383038 - protein, 9 aa, Homo Sapiens
PTNRQPRDK

SEQ ID NO: 1383039 - protein, 9 aa, Homo Sapiens
AHKRGSHFW

SEQ ID NO: 1383040 - protein, 9 aa, Homo Sapiens
LKTRVSLLN

SEQ ID NO: 1383041 - protein, 9 aa, Homo Sapiens
SRVQATSVE

SEQ ID NO: 1383042 - protein, 9 aa, Homo Sapiens
LRHLLCHGQ

SEQ ID NO: 1383043 - protein, 9 aa, Homo Sapiens
KKGSWCLFC

SEQ ID NO: 1383044 - protein, 9 aa, Homo Sapiens
STQGKNHHH

SEQ ID NO: 1383045 - protein, 9 aa, Homo Sapiens
VPCVPSPCR

SEQ ID NO: 1383046 - protein, 9 aa, Homo Sapiens
DFVAEYIDS

SEQ ID NO: 1383047 - protein, 9 aa, Homo Sapiens
CQIMVMMWM

SEQ ID NO: 1383048 - protein, 9 aa, Homo Sapiens
PSRPRHPRH

SEQ ID NO: 1383049 - protein, 9 aa, Homo Sapiens
FPAKVQGQA

SEQ ID NO: 1383050 - protein, 9 aa, Homo Sapiens
SRCAPGTQV

SEQ ID NO: 1383051 - protein, 9 aa, Homo Sapiens
WKKGLGKGN

SEQ ID NO: 1383052 - protein, 9 aa, Homo Sapiens
QQQDYGSAQ

SEQ ID NO: 1383053 - protein, 9 aa, Homo Sapiens
GRVSMCAAF

SEQ ID NO: 1383054 - protein, 9 aa, Homo Sapiens
SVATQQTTA

SEQ ID NO: 1383055 - protein, 9 aa, Homo Sapiens
EETVHIVAL

SEQ ID NO: 1383056 - protein, 9 aa, Homo Sapiens
AVDAVRARA

SEQ ID NO: 1383057 - protein, 9 aa, Homo Sapiens
GGGCLPPEP

SEQ ID NO: 1383058 - protein, 9 aa, Homo Sapiens
QGGPRRGWG

SEQ ID NO: 1383059 - protein, 9 aa, Homo Sapiens
QLEKISTTS

SEQ ID NO: 1383060 - protein, 9 aa, Homo Sapiens
PPKCPGGRR

SEQ ID NO: 1383061 - protein, 9 aa, Homo Sapiens
ATTDKLWEQ

SEQ ID NO: 1383062 - protein, 9 aa, Homo Sapiens
NQGKKYYQK

SEQ ID NO: 1383063 - protein, 9 aa, Homo Sapiens
PNMIPTNRQ

SEQ ID NO: 1383064 - protein, 9 aa, Homo Sapiens
QVLVDIHLW

SEQ ID NO: 1383065 - protein, 9 aa, Homo Sapiens
CLGAFGQFW

SEQ ID NO: 1383066 - protein, 9 aa, Homo Sapiens
GEFKNLKNL

SEQ ID NO: 1383067 - protein, 9 aa, Homo Sapiens
TVSSLRCHR

SEQ ID NO: 1383068 - protein, 9 aa, Homo Sapiens
VQRPRCFLT

SEQ ID NO: 1383069 - protein, 9 aa, Homo Sapiens
RGRPCGRPR

SEQ ID NO: 1383070 - protein, 9 aa, Homo Sapiens
KDDDFLEKK

SEQ ID NO: 1383071 - protein, 9 aa, Homo Sapiens
AVYFSQAVG

SEQ ID NO: 1383072 - protein, 9 aa, Homo Sapiens
KKLRKRLYQ

SEQ ID NO: 1383073 - protein, 9 aa, Homo Sapiens
SATLPINPT

SEQ ID NO: 1383074 - protein, 9 aa, Homo Sapiens
WDKIAMEKH

SEQ ID NO: 1383075 - protein, 9 aa, Homo Sapiens
GHPAGGHRV

SEQ ID NO: 1383076 - protein, 9 aa, Homo Sapiens
SAECKSRGS

SEQ ID NO: 1383077 - protein, 9 aa, Homo Sapiens
SMPSAQGGR

SEQ ID NO: 1383078 - protein, 9 aa, Homo Sapiens
AITKCCGLR

SEQ ID NO: 1383079 - protein, 9 aa, Homo Sapiens
RQLFEFFVV

SEQ ID NO: 1383080 - protein, 9 aa, Homo Sapiens
DQVTTAMLS

SEQ ID NO: 1383081 - protein, 9 aa, Homo Sapiens
RIPINTDIG

SEQ ID NO: 1383082 - protein, 9 aa, Homo Sapiens
ELQENSSTP

SEQ ID NO: 1383083 - protein, 9 aa, Homo Sapiens
KQATQPKEG

SEQ ID NO: 1383084 - protein, 9 aa, Homo Sapiens
SLQEWIDMT

SEQ ID NO: 1383085 - protein, 9 aa, Homo Sapiens
FSLAIALFT

SEQ ID NO: 1383086 - protein, 9 aa, Homo Sapiens
AFSQNIHLI

SEQ ID NO: 1383087 - protein, 9 aa, Homo Sapiens
ADPHTCPIR

SEQ ID NO: 1383088 - protein, 9 aa, Homo Sapiens
KNLCCFKWT

SEQ ID NO: 1383089 - protein, 9 aa, Homo Sapiens
AISEGLRSP

SEQ ID NO: 1383090 - protein, 9 aa, Homo Sapiens
RDSYVHELM

SEQ ID NO: 1383091 - protein, 9 aa, Homo Sapiens
IAVLYLKKK

SEQ ID NO: 1383092 - protein, 9 aa, Homo Sapiens
GKKNLCCFK

SEQ ID NO: 1383093 - protein, 9 aa, Homo Sapiens
LGVIEETGF

SEQ ID NO: 1383094 - protein, 9 aa, Homo Sapiens
QQNKNTPST

SEQ ID NO: 1383095 - protein, 9 aa, Homo Sapiens
LLSLLCRYY

SEQ ID NO: 1383096 - protein, 9 aa, Homo Sapiens
KKDFGKNDC

SEQ ID NO: 1383097 - protein, 9 aa, Homo Sapiens
EQFRHVIWK

SEQ ID NO: 1383098 - protein, 9 aa, Homo Sapiens
PGPRPTATP

SEQ ID NO: 1383099 - protein, 9 aa, Homo Sapiens
NSCSCSNLT

SEQ ID NO: 1383100 - protein, 9 aa, Homo Sapiens
IEAHKRGSH

SEQ ID NO: 1383101 - protein, 9 aa, Homo Sapiens
TAQDRAGVT

SEQ ID NO: 1383102 - protein, 9 aa, Homo Sapiens
PGTDFVAEY

SEQ ID NO: 1383103 - protein, 9 aa, Homo Sapiens
PTFTLRKKT

SEQ ID NO: 1383104 - protein, 9 aa, Homo Sapiens
ELAESFKSE

SEQ ID NO: 1383105 - protein, 9 aa, Homo Sapiens
YFLMCAPKH

SEQ ID NO: 1383106 - protein, 9 aa, Homo Sapiens
PKDVNIQVR

SEQ ID NO: 1383107 - protein, 9 aa, Homo Sapiens
VLYQIEKMF

SEQ ID NO: 1383108 - protein, 9 aa, Homo Sapiens
HYIIRVVSF

SEQ ID NO: 1383109 - protein, 9 aa, Homo Sapiens
FETSSYGTI

SEQ ID NO: 1383110 - protein, 9 aa, Homo Sapiens
LYCLFSQQT

SEQ ID NO: 1383111 - protein, 9 aa, Homo Sapiens
QHNIPQQEV

SEQ ID NO: 1383112 - protein, 9 aa, Homo Sapiens
LWNGELVTG

SEQ ID NO: 1383113 - protein, 9 aa, Homo Sapiens
EKEDIKCVK

SEQ ID NO: 1383114 - protein, 9 aa, Homo Sapiens
EEDGDFVIE

SEQ ID NO: 1383115 - protein, 9 aa, Homo Sapiens
GLECRTHRA

SEQ ID NO: 1383116 - protein, 9 aa, Homo Sapiens
YQAAWRKMQ

SEQ ID NO: 1383117 - protein, 9 aa, Homo Sapiens
ALMLLAAWI

SEQ ID NO: 1383118 - protein, 9 aa, Homo Sapiens
SLSGPRMLW

SEQ ID NO: 1383119 - protein, 9 aa, Homo Sapiens
VGANSTCWQ

SEQ ID NO: 1383120 - protein, 9 aa, Homo Sapiens
WGDFHYKTV

SEQ ID NO: 1383121 - protein, 9 aa, Homo Sapiens
SPISLPLDR

SEQ ID NO: 1383122 - protein, 9 aa, Homo Sapiens
LYQLYCLFS

SEQ ID NO: 1383123 - protein, 9 aa, Homo Sapiens
VGKCLADGA

SEQ ID NO: 1383124 - protein, 9 aa, Homo Sapiens
LNKVLYPPL

SEQ ID NO: 1383125 - protein, 9 aa, Homo Sapiens
LAESFKSEH

SEQ ID NO: 1383126 - protein, 9 aa, Homo Sapiens
PSYTGGRGR

SEQ ID NO: 1383127 - protein, 9 aa, Homo Sapiens
EFGDLEVAQ

SEQ ID NO: 1383128 - protein, 9 aa, Homo Sapiens
EPQNELWIA

SEQ ID NO: 1383129 - protein, 9 aa, Homo Sapiens
GPAALHPGL

SEQ ID NO: 1383130 - protein, 9 aa, Homo Sapiens
VTLVRPLWD

SEQ ID NO: 1383131 - protein, 9 aa, Homo Sapiens
SSRLTLEQL

SEQ ID NO: 1383132 - protein, 9 aa, Homo Sapiens
KVQDKEGIP

SEQ ID NO: 1383133 - protein, 9 aa, Homo Sapiens
RELQRPQLG

SEQ ID NO: 1383134 - protein, 9 aa, Homo Sapiens
REEIYFLST

SEQ ID NO: 1383135 - protein, 9 aa, Homo Sapiens
WMLARSSRA

SEQ ID NO: 1383136 - protein, 9 aa, Homo Sapiens
LRNHYIIRV

SEQ ID NO: 1383137 - protein, 9 aa, Homo Sapiens
LRRGPQGGA

SEQ ID NO: 1383138 - protein, 9 aa, Homo Sapiens
WGSLTVQNS

SEQ ID NO: 1383139 - protein, 9 aa, Homo Sapiens
SNHTTNCFG

SEQ ID NO: 1383140 - protein, 9 aa, Homo Sapiens
REKILNREI

SEQ ID NO: 1383141 - protein, 9 aa, Homo Sapiens
QRLRVLYQI

SEQ ID NO: 1383142 - protein, 9 aa, Homo Sapiens
EEPGPRPTA

SEQ ID NO: 1383143 - protein, 9 aa, Homo Sapiens
ELVTGLPGS

SEQ ID NO: 1383144 - protein, 9 aa, Homo Sapiens
SDLLDDGEV

SEQ ID NO: 1383145 - protein, 9 aa, Homo Sapiens
SALLQEDLA

SEQ ID NO: 1383146 - protein, 9 aa, Homo Sapiens
VAAGRGHGE

SEQ ID NO: 1383147 - protein, 9 aa, Homo Sapiens
ANRMPKDVN

SEQ ID NO: 1383148 - protein, 9 aa, Homo Sapiens
HLGLGWTEL

SEQ ID NO: 1383149 - protein, 9 aa, Homo Sapiens
DAVDPRSNG

SEQ ID NO: 1383150 - protein, 9 aa, Homo Sapiens
KGEKGIMVS

SEQ ID NO: 1383151 - protein, 9 aa, Homo Sapiens
LAMTVTTSG

SEQ ID NO: 1383152 - protein, 9 aa, Homo Sapiens
IPLRDGGDH

SEQ ID NO: 1383153 - protein, 9 aa, Homo Sapiens
LLSLPNMIP

SEQ ID NO: 1383154 - protein, 9 aa, Homo Sapiens
GYCAGHTHS

SEQ ID NO: 1383155 - protein, 9 aa, Homo Sapiens
GHFVCVLGR

SEQ ID NO: 1383156 - protein, 9 aa, Homo Sapiens
RCFLTLPLT

SEQ ID NO: 1383157 - protein, 9 aa, Homo Sapiens
VFQLLTDPK

SEQ ID NO: 1383158 - protein, 9 aa, Homo Sapiens
DDREREGKG

SEQ ID NO: 1383159 - protein, 9 aa, Homo Sapiens
KRSRVELLL

SEQ ID NO: 1383160 - protein, 9 aa, Homo Sapiens
HSSRLTLEQ

SEQ ID NO: 1383161 - protein, 9 aa, Homo Sapiens
VPPCDHHGD

SEQ ID NO: 1383162 - protein, 9 aa, Homo Sapiens
NQVLVDIHL

SEQ ID NO: 1383163 - protein, 9 aa, Homo Sapiens
IRKNVFKEA

SEQ ID NO: 1383164 - protein, 9 aa, Homo Sapiens
DGENKRSTD

SEQ ID NO: 1383165 - protein, 9 aa, Homo Sapiens
CVKSLVVQH

SEQ ID NO: 1383166 - protein, 9 aa, Homo Sapiens
YDNTPGISQ

SEQ ID NO: 1383167 - protein, 9 aa, Homo Sapiens
YTSMMSGGR

SEQ ID NO: 1383168 - protein, 9 aa, Homo Sapiens
PAVPCVPSP

SEQ ID NO: 1383169 - protein, 9 aa, Homo Sapiens
KAGTAAVAD

SEQ ID NO: 1383170 - protein, 9 aa, Homo Sapiens
VQSHSAVHG

SEQ ID NO: 1383171 - protein, 9 aa, Homo Sapiens
RGWRPLRKT

SEQ ID NO: 1383172 - protein, 9 aa, Homo Sapiens
TLSLHRWTG

SEQ ID NO: 1383173 - protein, 9 aa, Homo Sapiens
REVPQQRLG

SEQ ID NO: 1383174 - protein, 9 aa, Homo Sapiens
LDQREKAKK

SEQ ID NO: 1383175 - protein, 9 aa, Homo Sapiens
PLLPVSQEF

SEQ ID NO: 1383176 - protein, 9 aa, Homo Sapiens
NRRIRDEKG

SEQ ID NO: 1383177 - protein, 9 aa, Homo Sapiens
PDYDRMSSS

SEQ ID NO: 1383178 - protein, 9 aa, Homo Sapiens
QVTYMGSFM

SEQ ID NO: 1383179 - protein, 9 aa, Homo Sapiens
VYPNGHFVC

SEQ ID NO: 1383180 - protein, 9 aa, Homo Sapiens
LATSIRWGA

SEQ ID NO: 1383181 - protein, 9 aa, Homo Sapiens
KVPPQEGPH

SEQ ID NO: 1383182 - protein, 9 aa, Homo Sapiens
EEEEGFDWS

SEQ ID NO: 1383183 - protein, 9 aa, Homo Sapiens
ASVVVAVRG

SEQ ID NO: 1383184 - protein, 9 aa, Homo Sapiens
QSQIIENVD

SEQ ID NO: 1383185 - protein, 9 aa, Homo Sapiens
AYQSVHTLG

SEQ ID NO: 1383186 - protein, 9 aa, Homo Sapiens
SLRQISGRH

SEQ ID NO: 1383187 - protein, 9 aa, Homo Sapiens
ECRTHRAVL

SEQ ID NO: 1383188 - protein, 9 aa, Homo Sapiens
PPEPGLWRE

SEQ ID NO: 1383189 - protein, 9 aa, Homo Sapiens
LLGANLNIK

SEQ ID NO: 1383190 - protein, 9 aa, Homo Sapiens
EVAQENQGG

SEQ ID NO: 1383191 - protein, 9 aa, Homo Sapiens
STPATPSSL

SEQ ID NO: 1383192 - protein, 9 aa, Homo Sapiens
SVFSVLSVI

SEQ ID NO: 1383193 - protein, 9 aa, Homo Sapiens
YSTPTSPTH

SEQ ID NO: 1383194 - protein, 9 aa, Homo Sapiens
CQLGHPAGG

SEQ ID NO: 1383195 - protein, 9 aa, Homo Sapiens
VQVTYMGSF

SEQ ID NO: 1383196 - protein, 9 aa, Homo Sapiens
TVLPHIWKV

SEQ ID NO: 1383197 - protein, 9 aa, Homo Sapiens
TLVLLMFNA

SEQ ID NO: 1383198 - protein, 9 aa, Homo Sapiens
RELPLQRQQ

SEQ ID NO: 1383199 - protein, 9 aa, Homo Sapiens
ANLAISLTT

SEQ ID NO: 1383200 - protein, 9 aa, Homo Sapiens
PRPANYSPG

SEQ ID NO: 1383201 - protein, 9 aa, Homo Sapiens
RHSWSGVAF

SEQ ID NO: 1383202 - protein, 9 aa, Homo Sapiens
FMKGCLKVN

SEQ ID NO: 1383203 - protein, 9 aa, Homo Sapiens
TQGLECRTH

SEQ ID NO: 1383204 - protein, 9 aa, Homo Sapiens
KQRQARLGY

SEQ ID NO: 1383205 - protein, 9 aa, Homo Sapiens
KTPWLNHVS

SEQ ID NO: 1383206 - protein, 9 aa, Homo Sapiens
AATRMGTPR

SEQ ID NO: 1383207 - protein, 9 aa, Homo Sapiens
YNEDFERAW

SEQ ID NO: 1383208 - protein, 9 aa, Homo Sapiens
TDPQLHRII

SEQ ID NO: 1383209 - protein, 9 aa, Homo Sapiens
GAASGVAAV

SEQ ID NO: 1383210 - protein, 9 aa, Homo Sapiens
AGRGHGEVP

SEQ ID NO: 1383211 - protein, 9 aa, Homo Sapiens
SAPLPILCV

SEQ ID NO: 1383212 - protein, 9 aa, Homo Sapiens
IIILSLMEL

SEQ ID NO: 1383213 - protein, 9 aa, Homo Sapiens
SRPRHPRHH

SEQ ID NO: 1383214 - protein, 9 aa, Homo Sapiens
LASKDEGLK

SEQ ID NO: 1383215 - protein, 9 aa, Homo Sapiens
VEMLKFEAR

SEQ ID NO: 1383216 - protein, 9 aa, Homo Sapiens
MREVAEAAA

SEQ ID NO: 1383217 - protein, 9 aa, Homo Sapiens
KSTSQTFPR

SEQ ID NO: 1383218 - protein, 9 aa, Homo Sapiens
AEAAAVVMV

SEQ ID NO: 1383219 - protein, 9 aa, Homo Sapiens
TCSAPATVP

SEQ ID NO: 1383220 - protein, 9 aa, Homo Sapiens
LLPAVNPWY

SEQ ID NO: 1383221 - protein, 9 aa, Homo Sapiens
TWTCSAPAT

SEQ ID NO: 1383222 - protein, 9 aa, Homo Sapiens
IGKVYLKKK

SEQ ID NO: 1383223 - protein, 9 aa, Homo Sapiens
VEWLSGLLD

SEQ ID NO: 1383224 - protein, 9 aa, Homo Sapiens
AKVSQDHHN

SEQ ID NO: 1383225 - protein, 9 aa, Homo Sapiens
TRYEEKKTG

SEQ ID NO: 1383226 - protein, 9 aa, Homo Sapiens
VHRVGANST

SEQ ID NO: 1383227 - protein, 9 aa, Homo Sapiens
GKAAWAEYE

SEQ ID NO: 1383228 - protein, 9 aa, Homo Sapiens
PEASAITRT

SEQ ID NO: 1383229 - protein, 9 aa, Homo Sapiens
KWPQWLHQQ

SEQ ID NO: 1383230 - protein, 9 aa, Homo Sapiens
PAYVAPEVL

SEQ ID NO: 1383231 - protein, 9 aa, Homo Sapiens
RLVLAGGAS

SEQ ID NO: 1383232 - protein, 9 aa, Homo Sapiens
TQQTTASSI

SEQ ID NO: 1383233 - protein, 9 aa, Homo Sapiens
RTNSPQARL

SEQ ID NO: 1383234 - protein, 9 aa, Homo Sapiens
RHWVLGISW

SEQ ID NO: 1383235 - protein, 9 aa, Homo Sapiens
GGESSGDSD

SEQ ID NO: 1383236 - protein, 9 aa, Homo Sapiens
DPDAVVASS

SEQ ID NO: 1383237 - protein, 9 aa, Homo Sapiens
TSIRWGADA

SEQ ID NO: 1383238 - protein, 9 aa, Homo Sapiens
ELVQYKWPQ

SEQ ID NO: 1383239 - protein, 9 aa, Homo Sapiens
QPLRRGPQG

SEQ ID NO: 1383240 - protein, 9 aa, Homo Sapiens
NICQIFSHC

SEQ ID NO: 1383241 - protein, 9 aa, Homo Sapiens
LLGAVSKGQ

SEQ ID NO: 1383242 - protein, 9 aa, Homo Sapiens
ENICQIFSH

SEQ ID NO: 1383243 - protein, 9 aa, Homo Sapiens
PKKCPCRTL

SEQ ID NO: 1383244 - protein, 9 aa, Homo Sapiens
INPVKQEET

SEQ ID NO: 1383245 - protein, 9 aa, Homo Sapiens
VEGAVIIPG

SEQ ID NO: 1383246 - protein, 9 aa, Homo Sapiens
SQTARAPEA

SEQ ID NO: 1383247 - protein, 9 aa, Homo Sapiens
FAGFGFYPY

SEQ ID NO: 1383248 - protein, 9 aa, Homo Sapiens
KRKKEMVKV

SEQ ID NO: 1383249 - protein, 9 aa, Homo Sapiens
KNPKVHFNV

SEQ ID NO: 1383250 - protein, 9 aa, Homo Sapiens
IVQSPDGSD

SEQ ID NO: 1383251 - protein, 9 aa, Homo Sapiens
CTQEDILGD

SEQ ID NO: 1383252 - protein, 9 aa, Homo Sapiens
MLTEEEVQK

SEQ ID NO: 1383253 - protein, 9 aa, Homo Sapiens
PGRYYKQPD

SEQ ID NO: 1383254 - protein, 9 aa, Homo Sapiens
YPETKENEI

SEQ ID NO: 1383255 - protein, 9 aa, Homo Sapiens
FFDETRQLC

SEQ ID NO: 1383256 - protein, 9 aa, Homo Sapiens
FIMPGAFKG

SEQ ID NO: 1383257 - protein, 9 aa, Homo Sapiens
AFFGSYFFN

SEQ ID NO: 1383258 - protein, 9 aa, Homo Sapiens
QESHNRQLS

SEQ ID NO: 1383259 - protein, 9 aa, Homo Sapiens
DYTNAMKKL

SEQ ID NO: 1383260 - protein, 9 aa, Homo Sapiens
CSECGQGFS

SEQ ID NO: 1383261 - protein, 9 aa, Homo Sapiens
AGFGFYPYK

SEQ ID NO: 1383262 - protein, 9 aa, Homo Sapiens
YYKQPDNGV

SEQ ID NO: 1383263 - protein, 9 aa, Homo Sapiens
KQPDNGVLN

SEQ ID NO: 1383264 - protein, 9 aa, Homo Sapiens
PSPAPNEVL

SEQ ID NO: 1383265 - protein, 9 aa, Homo Sapiens
AEISHSFRS

SEQ ID NO: 1383266 - protein, 9 aa, Homo Sapiens
LSLKLVGLT

SEQ ID NO: 1383267 - protein, 9 aa, Homo Sapiens
RVAWLNCST

SEQ ID NO: 1383268 - protein, 9 aa, Homo Sapiens
SVLKDPDNN

SEQ ID NO: 1383269 - protein, 9 aa, Homo Sapiens
WLNCSTILY

SEQ ID NO: 1383270 - protein, 9 aa, Homo Sapiens
EISHSFRSQ

SEQ ID NO: 1383271 - protein, 9 aa, Homo Sapiens
AGATGAQVA

SEQ ID NO: 1383272 - protein, 9 aa, Homo Sapiens
EFFDETRQL

SEQ ID NO: 1383273 - protein, 9 aa, Homo Sapiens
NASEVRRIP

SEQ ID NO: 1383274 - protein, 9 aa, Homo Sapiens
FGFYPYKQR

SEQ ID NO: 1383275 - protein, 9 aa, Homo Sapiens
NELPKIVIV

SEQ ID NO: 1383276 - protein, 9 aa, Homo Sapiens
HCVTLEPDN

SEQ ID NO: 1383277 - protein, 9 aa, Homo Sapiens
RDVLTTTFV

SEQ ID NO: 1383278 - protein, 9 aa, Homo Sapiens
HFNVTDMLQ

SEQ ID NO: 1383279 - protein, 9 aa, Homo Sapiens
FDETRQLCD

SEQ ID NO: 1383280 - protein, 9 aa, Homo Sapiens
LTEEEVQKL

SEQ ID NO: 1383281 - protein, 9 aa, Homo Sapiens
IMPGAFKGL

SEQ ID NO: 1383282 - protein, 9 aa, Homo Sapiens
SLNSPHTPK

SEQ ID NO: 1383283 - protein, 9 aa, Homo Sapiens
NSPHTPKKP

SEQ ID NO: 1383284 - protein, 9 aa, Homo Sapiens
RSSKLPWCW

SEQ ID NO: 1383285 - protein, 9 aa, Homo Sapiens
LSFIMPGAF

SEQ ID NO: 1383286 - protein, 9 aa, Homo Sapiens
TLEDSSVNL

SEQ ID NO: 1383287 - protein, 9 aa, Homo Sapiens
APERPPEKP

SEQ ID NO: 1383288 - protein, 9 aa, Homo Sapiens
TEEEVQKLK

SEQ ID NO: 1383289 - protein, 9 aa, Homo Sapiens
ASFSNGPVL

SEQ ID NO: 1383290 - protein, 9 aa, Homo Sapiens
VAWLNCSTI

SEQ ID NO: 1383291 - protein, 9 aa, Homo Sapiens
YCGQLALIN

SEQ ID NO: 1383292 - protein, 9 aa, Homo Sapiens
AVSTRVRWC

SEQ ID NO: 1383293 - protein, 9 aa, Homo Sapiens
NPKVHFNVT

SEQ ID NO: 1383294 - protein, 9 aa, Homo Sapiens
FKHWDSIVE

SEQ ID NO: 1383295 - protein, 9 aa, Homo Sapiens
KIVIVQSPD

SEQ ID NO: 1383296 - protein, 9 aa, Homo Sapiens
MSSNASEVR

SEQ ID NO: 1383297 - protein, 9 aa, Homo Sapiens
VEEDTQFNY

SEQ ID NO: 1383298 - protein, 9 aa, Homo Sapiens
WDSIVETLK

SEQ ID NO: 1383299 - protein, 9 aa, Homo Sapiens
VYPETKENE

SEQ ID NO: 1383300 - protein, 9 aa, Homo Sapiens
TETSAPERP

SEQ ID NO: 1383301 - protein, 9 aa, Homo Sapiens
LNSPHTPKK

SEQ ID NO: 1383302 - protein, 9 aa, Homo Sapiens
EEFFDETRQ

SEQ ID NO: 1383303 - protein, 9 aa, Homo Sapiens
DVLTTTFVD

SEQ ID NO: 1383304 - protein, 9 aa, Homo Sapiens
QHCVTLEPD

SEQ ID NO: 1383305 - protein, 9 aa, Homo Sapiens
LKLAGWQCP

SEQ ID NO: 1383306 - protein, 9 aa, Homo Sapiens
RKQDYTNAM

SEQ ID NO: 1383307 - protein, 9 aa, Homo Sapiens
VFKHWDSIV

SEQ ID NO: 1383308 - protein, 9 aa, Homo Sapiens
RRIPEGEKW

SEQ ID NO: 1383309 - protein, 9 aa, Homo Sapiens
QLPVFKHWD

SEQ ID NO: 1383310 - protein, 9 aa, Homo Sapiens
LKSVTSASF

SEQ ID NO: 1383311 - protein, 9 aa, Homo Sapiens
SSNASEVRR

SEQ ID NO: 1383312 - protein, 9 aa, Homo Sapiens
DETRQLCDL

SEQ ID NO: 1383313 - protein, 9 aa, Homo Sapiens
VIVQSPDGS

SEQ ID NO: 1383314 - protein, 9 aa, Homo Sapiens
LHSLNSPHT

SEQ ID NO: 1383315 - protein, 9 aa, Homo Sapiens
PAGATGAQV

SEQ ID NO: 1383316 - protein, 9 aa, Homo Sapiens
ERSKDFRWE

SEQ ID NO: 1383317 - protein, 9 aa, Homo Sapiens
YPYKQRTAP

SEQ ID NO: 1383318 - protein, 9 aa, Homo Sapiens
WECRDERIR

SEQ ID NO: 1383319 - protein, 9 aa, Homo Sapiens
ELYPAFFGS

SEQ ID NO: 1383320 - protein, 9 aa, Homo Sapiens
KRKQDYTNA

SEQ ID NO: 1383321 - protein, 9 aa, Homo Sapiens
EVRRIPEGE

SEQ ID NO: 1383322 - protein, 9 aa, Homo Sapiens
RQLCDLRLF

SEQ ID NO: 1383323 - protein, 9 aa, Homo Sapiens
QVSYAPVFE

SEQ ID NO: 1383324 - protein, 9 aa, Homo Sapiens
SSVLKDPDN

SEQ ID NO: 1383325 - protein, 9 aa, Homo Sapiens
LQVSYAPVF

SEQ ID NO: 1383326 - protein, 9 aa, Homo Sapiens
NVTDMLQDA

SEQ ID NO: 1383327 - protein, 9 aa, Homo Sapiens
NKVPSPAPN

SEQ ID NO: 1383328 - protein, 9 aa, Homo Sapiens
NRQLSLKLV

SEQ ID NO: 1383329 - protein, 9 aa, Homo Sapiens
SEVRRIPEG

SEQ ID NO: 1383330 - protein, 9 aa, Homo Sapiens
GRYYKQPDN

SEQ ID NO: 1383331 - protein, 9 aa, Homo Sapiens
PVFKHWDSI

SEQ ID NO: 1383332 - protein, 9 aa, Homo Sapiens
HNRQLSLKL

SEQ ID NO: 1383333 - protein, 9 aa, Homo Sapiens
GSYFFNSMM

SEQ ID NO: 1383334 - protein, 9 aa, Homo Sapiens
WMQNKVPSP

SEQ ID NO: 1383335 - protein, 9 aa, Homo Sapiens
LSVSGRGSY

SEQ ID NO: 1383336 - protein, 9 aa, Homo Sapiens
SGAVSTRVR

SEQ ID NO: 1383337 - protein, 9 aa, Homo Sapiens
PVCGSDGST

SEQ ID NO: 1383338 - protein, 9 aa, Homo Sapiens
VAPQAQAGP

SEQ ID NO: 1383339 - protein, 9 aa, Homo Sapiens
RSKDFRWEC

SEQ ID NO: 1383340 - protein, 9 aa, Homo Sapiens
NDWLILQVS

SEQ ID NO: 1383341 - protein, 9 aa, Homo Sapiens
KDPDNNPYS

SEQ ID NO: 1383342 - protein, 9 aa, Homo Sapiens
DGSTYPSGC

SEQ ID NO: 1383343 - protein, 9 aa, Homo Sapiens
NSPAKGAQW

SEQ ID NO: 1383344 - protein, 9 aa, Homo Sapiens
PYKQRTAPK

SEQ ID NO: 1383345 - protein, 9 aa, Homo Sapiens
VMRNRDVLT

SEQ ID NO: 1383346 - protein, 9 aa, Homo Sapiens
LEDSSVNLL

SEQ ID NO: 1383347 - protein, 9 aa, Homo Sapiens
IITLEDSSV

SEQ ID NO: 1383348 - protein, 9 aa, Homo Sapiens
SSVNLLGRN

SEQ ID NO: 1383349 - protein, 9 aa, Homo Sapiens
HSRLQRLID

SEQ ID NO: 1383350 - protein, 9 aa, Homo Sapiens
GAGGYAPYA

SEQ ID NO: 1383351 - protein, 9 aa, Homo Sapiens
PARCTQEDI

SEQ ID NO: 1383352 - protein, 9 aa, Homo Sapiens
HSFRSQQEI

SEQ ID NO: 1383353 - protein, 9 aa, Homo Sapiens
LPKIVIVQS

SEQ ID NO: 1383354 - protein, 9 aa, Homo Sapiens
DIAVTPLKL

SEQ ID NO: 1383355 - protein, 9 aa, Homo Sapiens
VAEISHSFR

SEQ ID NO: 1383356 - protein, 9 aa, Homo Sapiens
KEFKHLDDY

SEQ ID NO: 1383357 - protein, 9 aa, Homo Sapiens
KHLDDYLNT

SEQ ID NO: 1383358 - protein, 9 aa, Homo Sapiens
KVEEDTQFN

SEQ ID NO: 1383359 - protein, 9 aa, Homo Sapiens
YTNAMKKLQ

SEQ ID NO: 1383360 - protein, 9 aa, Homo Sapiens
VTDMLQDAI

SEQ ID NO: 1383361 - protein, 9 aa, Homo Sapiens
CGQGFSQKS

SEQ ID NO: 1383362 - protein, 9 aa, Homo Sapiens
LLKSDNKVV

SEQ ID NO: 1383363 - protein, 9 aa, Homo Sapiens
LHNLHSRLQ

SEQ ID NO: 1383364 - protein, 9 aa, Homo Sapiens
FVMRNRDVL

SEQ ID NO: 1383365 - protein, 9 aa, Homo Sapiens
PNSPAKGAQ

SEQ ID NO: 1383366 - protein, 9 aa, Homo Sapiens
GSDGSTYPS

SEQ ID NO: 1383367 - protein, 9 aa, Homo Sapiens
RVHFHPNSP

SEQ ID NO: 1383368 - protein, 9 aa, Homo Sapiens
VNLLGRNSF

SEQ ID NO: 1383369 - protein, 9 aa, Homo Sapiens
SGAQLPARC

SEQ ID NO: 1383370 - protein, 9 aa, Homo Sapiens
AFQHCVTLE

SEQ ID NO: 1383371 - protein, 9 aa, Homo Sapiens
VAKNQMLTE

SEQ ID NO: 1383372 - protein, 9 aa, Homo Sapiens
KVHFNVTDM

SEQ ID NO: 1383373 - protein, 9 aa, Homo Sapiens
SLLKEFKHL

SEQ ID NO: 1383374 - protein, 9 aa, Homo Sapiens
VRRIPEGEK

SEQ ID NO: 1383375 - protein, 9 aa, Homo Sapiens
SECGQGFSQ

SEQ ID NO: 1383376 - protein, 9 aa, Homo Sapiens
EFKHLDDYL

SEQ ID NO: 1383377 - protein, 9 aa, Homo Sapiens
VHFHPNSPA

SEQ ID NO: 1383378 - protein, 9 aa, Homo Sapiens
TPLKLAGWQ

SEQ ID NO: 1383379 - protein, 9 aa, Homo Sapiens
YSVAEISHS

SEQ ID NO: 1383380 - protein, 9 aa, Homo Sapiens
QVYPETKEN

SEQ ID NO: 1383381 - protein, 9 aa, Homo Sapiens
LCCCFLLRS

SEQ ID NO: 1383382 - protein, 9 aa, Homo Sapiens
ETRQLCDLR

SEQ ID NO: 1383383 - protein, 9 aa, Homo Sapiens
PHTPKKPVN

SEQ ID NO: 1383384 - protein, 9 aa, Homo Sapiens
KSLLKEFKH

SEQ ID NO: 1383385 - protein, 9 aa, Homo Sapiens
HFHPNSPAK

SEQ ID NO: 1383386 - protein, 9 aa, Homo Sapiens
SASFSNGPV

SEQ ID NO: 1383387 - protein, 9 aa, Homo Sapiens
KHWDSIVET

SEQ ID NO: 1383388 - protein, 9 aa, Homo Sapiens
DNKVVDNQA

SEQ ID NO: 1383389 - protein, 9 aa, Homo Sapiens
LLKEFKHLD

SEQ ID NO: 1383390 - protein, 9 aa, Homo Sapiens
LKSDNKVVD

SEQ ID NO: 1383391 - protein, 9 aa, Homo Sapiens
NRDVLTTTF

SEQ ID NO: 1383392 - protein, 9 aa, Homo Sapiens
KAFQHCVTL

SEQ ID NO: 1383393 - protein, 9 aa, Homo Sapiens
PYVCSECGQ

SEQ ID NO: 1383394 - protein, 9 aa, Homo Sapiens
HSLNSPHTP

SEQ ID NO: 1383395 - protein, 9 aa, Homo Sapiens
VRWCRPDCR

SEQ ID NO: 1383396 - protein, 9 aa, Homo Sapiens
SDGSTYPSG

SEQ ID NO: 1383397 - protein, 9 aa, Homo Sapiens
KDFRWECRD

SEQ ID NO: 1383398 - protein, 9 aa, Homo Sapiens
NCSTILYAG

SEQ ID NO: 1383399 - protein, 9 aa, Homo Sapiens
IVIVQSPDG

SEQ ID NO: 1383400 - protein, 9 aa, Homo Sapiens
VSTRVRWCR

SEQ ID NO: 1383401 - protein, 9 aa, Homo Sapiens
RCTQEDILG

SEQ ID NO: 1383402 - protein, 9 aa, Homo Sapiens
TSASFSNGP

SEQ ID NO: 1383403 - protein, 9 aa, Homo Sapiens
KSVTSASFS

SEQ ID NO: 1383404 - protein, 9 aa, Homo Sapiens
SRLQRLIDH

SEQ ID NO: 1383405 - protein, 9 aa, Homo Sapiens
SHNRQLSLK

SEQ ID NO: 1383406 - protein, 9 aa, Homo Sapiens
TRVAWLNCS

SEQ ID NO: 1383407 - protein, 9 aa, Homo Sapiens
SKDFRWECR

SEQ ID NO: 1383408 - protein, 9 aa, Homo Sapiens
LKEFKHLDD

SEQ ID NO: 1383409 - protein, 9 aa, Homo Sapiens
FFGSYFFNS

SEQ ID NO: 1383410 - protein, 9 aa, Homo Sapiens
FLLRSSKLP

SEQ ID NO: 1383411 - protein, 9 aa, Homo Sapiens
ASEVRRIPE

SEQ ID NO: 1383412 - protein, 9 aa, Homo Sapiens
LHSRLQRLI

SEQ ID NO: 1383413 - protein, 9 aa, Homo Sapiens
RQLSLKLVG

SEQ ID NO: 1383414 - protein, 9 aa, Homo Sapiens
LIVSQVYPE

SEQ ID NO: 1383415 - protein, 9 aa, Homo Sapiens
QNKVPSPAP

SEQ ID NO: 1383416 - protein, 9 aa, Homo Sapiens
MQNKVPSPA

SEQ ID NO: 1383417 - protein, 9 aa, Homo Sapiens
LQRLIDHIR

SEQ ID NO: 1383418 - protein, 9 aa, Homo Sapiens
YPAFFGSYF

SEQ ID NO: 1383419 - protein, 9 aa, Homo Sapiens
MPGAFKGLP

SEQ ID NO: 1383420 - protein, 9 aa, Homo Sapiens
WNELPKIVI

SEQ ID NO: 1383421 - protein, 9 aa, Homo Sapiens
PLKLAGWQC

SEQ ID NO: 1383422 - protein, 9 aa, Homo Sapiens
ITLEDSSVN

SEQ ID NO: 1383423 - protein, 9 aa, Homo Sapiens
SVSGRGSYC

SEQ ID NO: 1383424 - protein, 9 aa, Homo Sapiens
CFLLRSSKL

SEQ ID NO: 1383425 - protein, 9 aa, Homo Sapiens
GATGAQVAP

SEQ ID NO: 1383426 - protein, 9 aa, Homo Sapiens
RVRWCRPDC

SEQ ID NO: 1383427 - protein, 9 aa, Homo Sapiens
SYCGQLALI

SEQ ID NO: 1383428 - protein, 9 aa, Homo Sapiens
PKIVIVQSP

SEQ ID NO: 1383429 - protein, 9 aa, Homo Sapiens
QLCDLRLFQ

SEQ ID NO: 1383430 - protein, 9 aa, Homo Sapiens
VLKDPDNNP

SEQ ID NO: 1383431 - protein, 9 aa, Homo Sapiens
VCSECGQGF

SEQ ID NO: 1383432 - protein, 9 aa, Homo Sapiens
SVAEISHSF

SEQ ID NO: 1383433 - protein, 9 aa, Homo Sapiens
RPGRYYKQP

SEQ ID NO: 1383434 - protein, 9 aa, Homo Sapiens
SFSNGPVLA

SEQ ID NO: 1383435 - protein, 9 aa, Homo Sapiens
TSAPERPPE

SEQ ID NO: 1383436 - protein, 9 aa, Homo Sapiens
SSGAVSTRV

SEQ ID NO: 1383437 - protein, 9 aa, Homo Sapiens
VTPLKLAGW

SEQ ID NO: 1383438 - protein, 9 aa, Homo Sapiens
SHSFRSQQE

SEQ ID NO: 1383439 - protein, 9 aa, Homo Sapiens
VSQVYPETK

SEQ ID NO: 1383440 - protein, 9 aa, Homo Sapiens
RYYKQPDNG

SEQ ID NO: 1383441 - protein, 9 aa, Homo Sapiens
VSGRGSYCG

SEQ ID NO: 1383442 - protein, 9 aa, Homo Sapiens
HNNLSFIMP

SEQ ID NO: 1383443 - protein, 9 aa, Homo Sapiens
FHPNSPAKG

SEQ ID NO: 1383444 - protein, 9 aa, Homo Sapiens
CGSDGSTYP

SEQ ID NO: 1383445 - protein, 9 aa, Homo Sapiens
LPVFKHWDS

SEQ ID NO: 1383446 - protein, 9 aa, Homo Sapiens
NNPYSLLDN

SEQ ID NO: 1383447 - protein, 9 aa, Homo Sapiens
VSYAPVFEG

SEQ ID NO: 1383448 - protein, 9 aa, Homo Sapiens
EDSSVNLLG

SEQ ID NO: 1383449 - protein, 9 aa, Homo Sapiens
WLILQVSYA

SEQ ID NO: 1383450 - protein, 9 aa, Homo Sapiens
GSAKAFQHC

SEQ ID NO: 1383451 - protein, 9 aa, Homo Sapiens
IAVTPLKLA

SEQ ID NO: 1383452 - protein, 9 aa, Homo Sapiens
TNAMKKLQE

SEQ ID NO: 1383453 - protein, 9 aa, Homo Sapiens
LPARCTQED

SEQ ID NO: 1383454 - protein, 9 aa, Homo Sapiens
LAGWQCPEC

SEQ ID NO: 1383455 - protein, 9 aa, Homo Sapiens
LELETETSA

SEQ ID NO: 1383456 - protein, 9 aa, Homo Sapiens
AVTPLKLAG

SEQ ID NO: 1383457 - protein, 9 aa, Homo Sapiens
HTPKKPVNS

SEQ ID NO: 1383458 - protein, 9 aa, Homo Sapiens
FRWECRDER

SEQ ID NO: 1383459 - protein, 9 aa, Homo Sapiens
VPSPAPNEV

SEQ ID NO: 1383460 - protein, 9 aa, Homo Sapiens
AKNQMLTEE

SEQ ID NO: 1383461 - protein, 9 aa, Homo Sapiens
LYPAFFGSY

SEQ ID NO: 1383462 - protein, 9 aa, Homo Sapiens
CLLKSDNKV

SEQ ID NO: 1383463 - protein, 9 aa, Homo Sapiens
VCLLKSDNK

SEQ ID NO: 1383464 - protein, 9 aa, Homo Sapiens
ETSAPERPP

SEQ ID NO: 1383465 - protein, 9 aa, Homo Sapiens
FKHLDDYLN

SEQ ID NO: 1383466 - protein, 9 aa, Homo Sapiens
SPAPNEVLN

SEQ ID NO: 1383467 - protein, 9 aa, Homo Sapiens
YAPYAAAAA

SEQ ID NO: 1383468 - protein, 9 aa, Homo Sapiens
STYPSGCQL

SEQ ID NO: 1383469 - protein, 9 aa, Homo Sapiens
LILQVSYAP

SEQ ID NO: 1383470 - protein, 9 aa, Homo Sapiens
KSDNKVVDN

SEQ ID NO: 1383471 - protein, 9 aa, Homo Sapiens
ESHNRQLSL

SEQ ID NO: 1383472 - protein, 9 aa, Homo Sapiens
LKDPDNNPY

SEQ ID NO: 1383473 - protein, 9 aa, Homo Sapiens
ECGQGFSQK

SEQ ID NO: 1383474 - protein, 9 aa, Homo Sapiens
TRVRWCRPD

SEQ ID NO: 1383475 - protein, 9 aa, Homo Sapiens
KVPSPAPNE

SEQ ID NO: 1383476 - protein, 9 aa, Homo Sapiens
QVAPQAQAG

SEQ ID NO: 1383477 - protein, 9 aa, Homo Sapiens
AQLPARCTQ

SEQ ID NO: 1383478 - protein, 9 aa, Homo Sapiens
SVNLLGRNS

SEQ ID NO: 1383479 - protein, 9 aa, Homo Sapiens
NLHSRLQRL

SEQ ID NO: 1383480 - protein, 9 aa, Homo Sapiens
SFIMPGAFK

SEQ ID NO: 1383481 - protein, 9 aa, Homo Sapiens
EVCLLKSDN

SEQ ID NO: 1383482 - protein, 9 aa, Homo Sapiens
DWLILQVSY

SEQ ID NO: 1383483 - protein, 9 aa, Homo Sapiens
SYFFNSMMG

SEQ ID NO: 1383484 - protein, 9 aa, Homo Sapiens
IVSQVYPET

SEQ ID NO: 1383485 - protein, 9 aa, Homo Sapiens
LLHNLHSRL

SEQ ID NO: 1383486 - protein, 9 aa, Homo Sapiens
LLRSSKLPW

SEQ ID NO: 1383487 - protein, 9 aa, Homo Sapiens
LRSSKLPWC

SEQ ID NO: 1383488 - protein, 9 aa, Homo Sapiens
AQVAPQAQA

SEQ ID NO: 1383489 - protein, 9 aa, Homo Sapiens
NQMLTEEEV

SEQ ID NO: 1383490 - protein, 9 aa, Homo Sapiens
AWMQNKVPS

SEQ ID NO: 1383491 - protein, 9 aa, Homo Sapiens
AWLNCSTIL

SEQ ID NO: 1383492 - protein, 9 aa, Homo Sapiens
IFAGFGFYP

SEQ ID NO: 1383493 - protein, 9 aa, Homo Sapiens
GRVHFHPNS

SEQ ID NO: 1383494 - protein, 9 aa, Homo Sapiens
RKKEMVKVE

SEQ ID NO: 1383495 - protein, 9 aa, Homo Sapiens
CSTILYAGN

SEQ ID NO: 1383496 - protein, 9 aa, Homo Sapiens
KKEMVKVEE

SEQ ID NO: 1383497 - protein, 9 aa, Homo Sapiens
GRGSYCGQL

SEQ ID NO: 1383498 - protein, 9 aa, Homo Sapiens
SAPERPPEK

SEQ ID NO: 1383499 - protein, 9 aa, Homo Sapiens
DPDNNPYSL

SEQ ID NO: 1383500 - protein, 9 aa, Homo Sapiens
DYSVAEISH

SEQ ID NO: 1383501 - protein, 9 aa, Homo Sapiens
AKAFQHCVT

SEQ ID NO: 1383502 - protein, 9 aa, Homo Sapiens
QGSAKAFQH

SEQ ID NO: 1383503 - protein, 9 aa, Homo Sapiens
TGAQVAPQA

SEQ ID NO: 1383504 - protein, 9 aa, Homo Sapiens
MVKVEEDTQ

SEQ ID NO: 1383505 - protein, 9 aa, Homo Sapiens
STRVRWCRP

SEQ ID NO: 1383506 - protein, 9 aa, Homo Sapiens
KEMVKVEED

SEQ ID NO: 1383507 - protein, 9 aa, Homo Sapiens
AGGYAPYAA

SEQ ID NO: 1383508 - protein, 9 aa, Homo Sapiens
ILQVSYAPV

SEQ ID NO: 1383509 - protein, 9 aa, Homo Sapiens
ALKSVTSAS

SEQ ID NO: 1383510 - protein, 9 aa, Homo Sapiens
FGSYFFNSM

SEQ ID NO: 1383511 - protein, 9 aa, Homo Sapiens
GSYCGQLAL

SEQ ID NO: 1383512 - protein, 9 aa, Homo Sapiens
NAMKKLQEI

SEQ ID NO: 1383513 - protein, 9 aa, Homo Sapiens
ATGAQVAPQ

SEQ ID NO: 1383514 - protein, 9 aa, Homo Sapiens
GYAPYAAAA

SEQ ID NO: 1383515 - protein, 9 aa, Homo Sapiens
QLPARCTQE

SEQ ID NO: 1383516 - protein, 9 aa, Homo Sapiens
VTRVAWLNC

SEQ ID NO: 1383517 - protein, 9 aa, Homo Sapiens
TRQLCDLRL

SEQ ID NO: 1383518 - protein, 9 aa, Homo Sapiens
ETETSAPER

SEQ ID NO: 1383519 - protein, 9 aa, Homo Sapiens
RLQRLIDHI

SEQ ID NO: 1383520 - protein, 9 aa, Homo Sapiens
SGRGSYCGQ

SEQ ID NO: 1383521 - protein, 9 aa, Homo Sapiens
FLCCCFLLR

SEQ ID NO: 1383522 - protein, 9 aa, Homo Sapiens
QMLTEEEVQ

SEQ ID NO: 1383523 - protein, 9 aa, Homo Sapiens
VERSKDFRW

SEQ ID NO: 1383524 - protein, 9 aa, Homo Sapiens
KQDYTNAMK

SEQ ID NO: 1383525 - protein, 9 aa, Homo Sapiens
MRNRDVLTT

SEQ ID NO: 1383526 - protein, 9 aa, Homo Sapiens
SYAPVFEGE

SEQ ID NO: 1383527 - protein, 9 aa, Homo Sapiens
QLSLKLVGL

SEQ ID NO: 1383528 - protein, 9 aa, Homo Sapiens
RGSYCGQLA

SEQ ID NO: 1383529 - protein, 9 aa, Homo Sapiens
LNCSTILYA

SEQ ID NO: 1383530 - protein, 9 aa, Homo Sapiens
PGRVHFHPN

SEQ ID NO: 1383531 - protein, 9 aa, Homo Sapiens
PAFFGSYFF

SEQ ID NO: 1383532 - protein, 9 aa, Homo Sapiens
SLKLVGLTQ

SEQ ID NO: 1383533 - protein, 9 aa, Homo Sapiens
NNLSFIMPG

SEQ ID NO: 1383534 - protein, 9 aa, Homo Sapiens
KNQMLTEEE

SEQ ID NO: 1383535 - protein, 9 aa, Homo Sapiens
RHNNLSFIM

SEQ ID NO: 1383536 - protein, 9 aa, Homo Sapiens
SAKAFQHCV

SEQ ID NO: 1383537 - protein, 9 aa, Homo Sapiens
EVAKNQMLT

SEQ ID NO: 1383538 - protein, 9 aa, Homo Sapiens
QDYTNAMKK

SEQ ID NO: 1383539 - protein, 9 aa, Homo Sapiens
LETETSAPE

SEQ ID NO: 1383540 - protein, 9 aa, Homo Sapiens
VKVEEDTQF

SEQ ID NO: 1383541 - protein, 9 aa, Homo Sapiens
GAQVAPQAQ

SEQ ID NO: 1383542 - protein, 9 aa, Homo Sapiens
VCGSDGSTY

SEQ ID NO: 1383543 - protein, 9 aa, Homo Sapiens
ARCTQEDIL

SEQ ID NO: 1383544 - protein, 9 aa, Homo Sapiens
KLAGWQCPE

SEQ ID NO: 1383545 - protein, 9 aa, Homo Sapiens
SPHTPKKPV

SEQ ID NO: 1383546 - protein, 9 aa, Homo Sapiens
EMVKVEEDT

SEQ ID NO: 1383547 - protein, 9 aa, Homo Sapiens
CCFLLRSSK

SEQ ID NO: 1383548 - protein, 9 aa, Homo Sapiens
SNASEVRRI

SEQ ID NO: 1383549 - protein, 9 aa, Homo Sapiens
TLHSLNSPH

SEQ ID NO: 1383550 - protein, 9 aa, Homo Sapiens
SDNKVVDNQ

SEQ ID NO: 1383551 - protein, 9 aa, Homo Sapiens
GFYPYKQRT

SEQ ID NO: 1383552 - protein, 9 aa, Homo Sapiens
DFRWECRDE

SEQ ID NO: 1383553 - protein, 9 aa, Homo Sapiens
QGFSQKSNL

SEQ ID NO: 1383554 - protein, 9 aa, Homo Sapiens
GQGFSQKSN

SEQ ID NO: 1383555 - protein, 9 aa, Homo Sapiens
GSTYPSGCQ

SEQ ID NO: 1383556 - protein, 9 aa, Homo Sapiens
FYPYKQRTA

SEQ ID NO: 1383557 - protein, 9 aa, Homo Sapiens
MELIVSQVY

SEQ ID NO: 1383558 - protein, 9 aa, Homo Sapiens
RWECRDERI

SEQ ID NO: 1383559 - protein, 9 aa, Homo Sapiens
CRPGRYYKQ

SEQ ID NO: 1383560 - protein, 9 aa, Homo Sapiens
KKRKQDYTN

SEQ ID NO: 1383561 - protein, 9 aa, Homo Sapiens
HNLHSRLQR

SEQ ID NO: 1383562 - protein, 9 aa, Homo Sapiens
DSSVNLLGR

SEQ ID NO: 1383563 - protein, 9 aa, Homo Sapiens
YVCSECGQG

SEQ ID NO: 1383564 - protein, 9 aa, Homo Sapiens
ELETETSAP

SEQ ID NO: 1383565 - protein, 9 aa, Homo Sapiens
YPVCGSDGS

SEQ ID NO: 1383566 - protein, 9 aa, Homo Sapiens
ELIVSQVYP

SEQ ID NO: 1383567 - protein, 9 aa, Homo Sapiens
YKQPDNGVL

SEQ ID NO: 1383568 - protein, 9 aa, Homo Sapiens
VTSASFSNG

SEQ ID NO: 1383569 - protein, 9 aa, Homo Sapiens
SQVYPETKE

SEQ ID NO: 1383570 - protein, 9 aa, Homo Sapiens
LEVCLLKSD

SEQ ID NO: 1383571 - protein, 9 aa, Homo Sapiens
QQLPVFKHW

SEQ ID NO: 1383572 - protein, 9 aa, Homo Sapiens
HPNSPAKGA

SEQ ID NO: 1383573 - protein, 9 aa, Homo Sapiens
HLDDYLNTP

SEQ ID NO: 1383574 - protein, 9 aa, Homo Sapiens
ELPKIVIVQ

SEQ ID NO: 1383575 - protein, 9 aa, Homo Sapiens
FQHCVTLEP

SEQ ID NO: 1383576 - protein, 9 aa, Homo Sapiens
GAVSTRVRW

SEQ ID NO: 1383577 - protein, 9 aa, Homo Sapiens
FNVTDMLQD

SEQ ID NO: 1383578 - protein, 9 aa, Homo Sapiens
PDNNPYSLL

SEQ ID NO: 1383579 - protein, 9 aa, Homo Sapiens
DNNPYSLLD

SEQ ID NO: 1383580 - protein, 9 aa, Homo Sapiens
ISHSFRSQQ

SEQ ID NO: 1383581 - protein, 9 aa, Homo Sapiens
CCCFLLRSS

SEQ ID NO: 1383582 - protein, 9 aa, Homo Sapiens
NLSFIMPGA

SEQ ID NO: 1383583 - protein, 9 aa, Homo Sapiens
VHFNVTDML

SEQ ID NO: 1383584 - protein, 9 aa, Homo Sapiens
GFGFYPYKQ

SEQ ID NO: 1383585 - protein, 9 aa, Homo Sapiens
PKVHFNVTD

SEQ ID NO: 1383586 - protein, 9 aa, Homo Sapiens
GGYAPYAAA

SEQ ID NO: 1383587 - protein, 9 aa, Homo Sapiens
GAQLPARCT

SEQ ID NO: 1383588 - protein, 9 aa, Homo Sapiens
RNRDVLTTT

SEQ ID NO: 1383589 - protein, 9 aa, Homo Sapiens
HWDSIVETL

SEQ ID NO: 1383590 - protein, 9 aa, Homo Sapiens
SVTSASFSN

SEQ ID NO: 1383591 - protein, 9 aa, Homo Sapiens
VCRPGRYYK

SEQ ID NO: 1383592 - protein, 9 aa, Homo Sapiens
LLLLDANKI

SEQ ID NO: 1383593 - protein, 9 aa, Homo Sapiens
ATKGRPRKI

SEQ ID NO: 1383594 - protein, 9 aa, Homo Sapiens
VECRNLFAF

SEQ ID NO: 1383595 - protein, 9 aa, Homo Sapiens
VQPGVLCCY

SEQ ID NO: 1383596 - protein, 9 aa, Homo Sapiens
TTEVIRNVA

SEQ ID NO: 1383597 - protein, 9 aa, Homo Sapiens
WCLTGTHPR

SEQ ID NO: 1383598 - protein, 9 aa, Homo Sapiens
CRNLFAFTP

SEQ ID NO: 1383599 - protein, 9 aa, Homo Sapiens
SRNSYLALA

SEQ ID NO: 1383600 - protein, 9 aa, Homo Sapiens
RRTMTRPSA

SEQ ID NO: 1383601 - protein, 9 aa, Homo Sapiens
SRTASGCAF

SEQ ID NO: 1383602 - protein, 9 aa, Homo Sapiens
MGKYVNFIT

SEQ ID NO: 1383603 - protein, 9 aa, Homo Sapiens
TLTKMILTK

SEQ ID NO: 1383604 - protein, 9 aa, Homo Sapiens
MSSGSLGRC

SEQ ID NO: 1383605 - protein, 9 aa, Homo Sapiens
WNSKLTYLL

SEQ ID NO: 1383606 - protein, 9 aa, Homo Sapiens
EPVIPKDEK

SEQ ID NO: 1383607 - protein, 9 aa, Homo Sapiens
KWGSSKSGK

SEQ ID NO: 1383608 - protein, 9 aa, Homo Sapiens
WRSLLSFRD

SEQ ID NO: 1383609 - protein, 9 aa, Homo Sapiens
ENVINVQDY

SEQ ID NO: 1383610 - protein, 9 aa, Homo Sapiens
NIENSERKG

SEQ ID NO: 1383611 - protein, 9 aa, Homo Sapiens
RTMTRPSAL

SEQ ID NO: 1383612 - protein, 9 aa, Homo Sapiens
KSHIKWICS

SEQ ID NO: 1383613 - protein, 9 aa, Homo Sapiens
GFTKHLFRE

SEQ ID NO: 1383614 - protein, 9 aa, Homo Sapiens
IAVRTVRTQ

SEQ ID NO: 1383615 - protein, 9 aa, Homo Sapiens
WDPGMDTAL

SEQ ID NO: 1383616 - protein, 9 aa, Homo Sapiens
LNRSKVESS

SEQ ID NO: 1383617 - protein, 9 aa, Homo Sapiens
GSLLLTQAR

SEQ ID NO: 1383618 - protein, 9 aa, Homo Sapiens
PQDGCNDGS

SEQ ID NO: 1383619 - protein, 9 aa, Homo Sapiens
QSSSLYVSP

SEQ ID NO: 1383620 - protein, 9 aa, Homo Sapiens
SITVSFVGQ

SEQ ID NO: 1383621 - protein, 9 aa, Homo Sapiens
LPGGLRHAL

SEQ ID NO: 1383622 - protein, 9 aa, Homo Sapiens
KQVRCIPNT

SEQ ID NO: 1383623 - protein, 9 aa, Homo Sapiens
NAVEELHSR

SEQ ID NO: 1383624 - protein, 9 aa, Homo Sapiens
MIVGSYLVP

SEQ ID NO: 1383625 - protein, 9 aa, Homo Sapiens
PLDSTKSFA

SEQ ID NO: 1383626 - protein, 9 aa, Homo Sapiens
LPRVPMNSL

SEQ ID NO: 1383627 - protein, 9 aa, Homo Sapiens
SARALPRRL

SEQ ID NO: 1383628 - protein, 9 aa, Homo Sapiens
EKTAKMKKG

SEQ ID NO: 1383629 - protein, 9 aa, Homo Sapiens
WMGPKCNRA

SEQ ID NO: 1383630 - protein, 9 aa, Homo Sapiens
ITGLCLPMI

SEQ ID NO: 1383631 - protein, 9 aa, Homo Sapiens
FRHLLGDAH

SEQ ID NO: 1383632 - protein, 9 aa, Homo Sapiens
TLLPLLESS

SEQ ID NO: 1383633 - protein, 9 aa, Homo Sapiens
EEQSEIERI

SEQ ID NO: 1383634 - protein, 9 aa, Homo Sapiens
GIVRRGRAG

SEQ ID NO: 1383635 - protein, 9 aa, Homo Sapiens
LLSLQTEGG

SEQ ID NO: 1383636 - protein, 9 aa, Homo Sapiens
CNFSCFFSV

SEQ ID NO: 1383637 - protein, 9 aa, Homo Sapiens
GSEDGEPLS

SEQ ID NO: 1383638 - protein, 9 aa, Homo Sapiens
DTAGQKYHS

SEQ ID NO: 1383639 - protein, 9 aa, Homo Sapiens
LGLFFLDKS

SEQ ID NO: 1383640 - protein, 9 aa, Homo Sapiens
GWLRNPDQS

SEQ ID NO: 1383641 - protein, 9 aa, Homo Sapiens
SSLVASSQN

SEQ ID NO: 1383642 - protein, 9 aa, Homo Sapiens
PSWPWTRCL

SEQ ID NO: 1383643 - protein, 9 aa, Homo Sapiens
SLQLLLLDA

SEQ ID NO: 1383644 - protein, 9 aa, Homo Sapiens
KRAKVLDQS

SEQ ID NO: 1383645 - protein, 9 aa, Homo Sapiens
GWSLWLSWR

SEQ ID NO: 1383646 - protein, 9 aa, Homo Sapiens
GTDILLIVR

SEQ ID NO: 1383647 - protein, 9 aa, Homo Sapiens
MWLWMSSGS

SEQ ID NO: 1383648 - protein, 9 aa, Homo Sapiens
TVVDENAVT

SEQ ID NO: 1383649 - protein, 9 aa, Homo Sapiens
FQWGESPWQ

SEQ ID NO: 1383650 - protein, 9 aa, Homo Sapiens
NGQVWASAI

SEQ ID NO: 1383651 - protein, 9 aa, Homo Sapiens
ETSSTGSSR

SEQ ID NO: 1383652 - protein, 9 aa, Homo Sapiens
HLVKISCVI

SEQ ID NO: 1383653 - protein, 9 aa, Homo Sapiens
SNGLEQICP

SEQ ID NO: 1383654 - protein, 9 aa, Homo Sapiens
IHIFSTVLR

SEQ ID NO: 1383655 - protein, 9 aa, Homo Sapiens
ILTTLSWTL

SEQ ID NO: 1383656 - protein, 9 aa, Homo Sapiens
VEIVLVDDF

SEQ ID NO: 1383657 - protein, 9 aa, Homo Sapiens
FSITEDLTS

SEQ ID NO: 1383658 - protein, 9 aa, Homo Sapiens
AIVSISALS

SEQ ID NO: 1383659 - protein, 9 aa, Homo Sapiens
VGTITEDVR

SEQ ID NO: 1383660 - protein, 9 aa, Homo Sapiens
SFIIRSLQH

SEQ ID NO: 1383661 - protein, 9 aa, Homo Sapiens
EEDDVEIGM

SEQ ID NO: 1383662 - protein, 9 aa, Homo Sapiens
PFSQLYIRN

SEQ ID NO: 1383663 - protein, 9 aa, Homo Sapiens
KAYISCSSL

SEQ ID NO: 1383664 - protein, 9 aa, Homo Sapiens
GLRPWWMPS

SEQ ID NO: 1383665 - protein, 9 aa, Homo Sapiens
NKSKICSER

SEQ ID NO: 1383666 - protein, 9 aa, Homo Sapiens
EERYGGTRL

SEQ ID NO: 1383667 - protein, 9 aa, Homo Sapiens
KVLILQRKK

SEQ ID NO: 1383668 - protein, 9 aa, Homo Sapiens
PAVPAAACP

SEQ ID NO: 1383669 - protein, 9 aa, Homo Sapiens
QNSLLHVYR

SEQ ID NO: 1383670 - protein, 9 aa, Homo Sapiens
DIVCDGRLY

SEQ ID NO: 1383671 - protein, 9 aa, Homo Sapiens
HPMDSKGDE

SEQ ID NO: 1383672 - protein, 9 aa, Homo Sapiens
HLFRHLLGD

SEQ ID NO: 1383673 - protein, 9 aa, Homo Sapiens
DGWVEEWYN

SEQ ID NO: 1383674 - protein, 9 aa, Homo Sapiens
LGKCFKKRP

SEQ ID NO: 1383675 - protein, 9 aa, Homo Sapiens
SLPGPCASL

SEQ ID NO: 1383676 - protein, 9 aa, Homo Sapiens
FLLIQPCIQ

SEQ ID NO: 1383677 - protein, 9 aa, Homo Sapiens
LVQPGVLCC

SEQ ID NO: 1383678 - protein, 9 aa, Homo Sapiens
MSHGEELRF

SEQ ID NO: 1383679 - protein, 9 aa, Homo Sapiens
PSLQDAEWC

SEQ ID NO: 1383680 - protein, 9 aa, Homo Sapiens
NIWVGAQEA

SEQ ID NO: 1383681 - protein, 9 aa, Homo Sapiens
HTSCCHAPG

SEQ ID NO: 1383682 - protein, 9 aa, Homo Sapiens
SQLYIRNLK

SEQ ID NO: 1383683 - protein, 9 aa, Homo Sapiens
SGSCPSLYW

SEQ ID NO: 1383684 - protein, 9 aa, Homo Sapiens
DVGIVLKVV

SEQ ID NO: 1383685 - protein, 9 aa, Homo Sapiens
SPISACPRL

SEQ ID NO: 1383686 - protein, 9 aa, Homo Sapiens
YAEEEKKED

SEQ ID NO: 1383687 - protein, 9 aa, Homo Sapiens
CGKVSFQPS

SEQ ID NO: 1383688 - protein, 9 aa, Homo Sapiens
CVIMEMLRS

SEQ ID NO: 1383689 - protein, 9 aa, Homo Sapiens
CWTGHTSDA

SEQ ID NO: 1383690 - protein, 9 aa, Homo Sapiens
VVKAFVTLA

SEQ ID NO: 1383691 - protein, 9 aa, Homo Sapiens
PQNPSNRSL

SEQ ID NO: 1383692 - protein, 9 aa, Homo Sapiens
RCAGIVRRG

SEQ ID NO: 1383693 - protein, 9 aa, Homo Sapiens
TACDITAWG

SEQ ID NO: 1383694 - protein, 9 aa, Homo Sapiens
TTGRLMTRS

SEQ ID NO: 1383695 - protein, 9 aa, Homo Sapiens
HSEMEEEKR

SEQ ID NO: 1383696 - protein, 9 aa, Homo Sapiens
TLGWGPEDG

SEQ ID NO: 1383697 - protein, 9 aa, Homo Sapiens
KTAKMKKGK

SEQ ID NO: 1383698 - protein, 9 aa, Homo Sapiens
KHNSNANII

SEQ ID NO: 1383699 - protein, 9 aa, Homo Sapiens
KLTFSFSLC

SEQ ID NO: 1383700 - protein, 9 aa, Homo Sapiens
EDYDQEPDG

SEQ ID NO: 1383701 - protein, 9 aa, Homo Sapiens
AEEQSEIER

SEQ ID NO: 1383702 - protein, 9 aa, Homo Sapiens
FWTSAGEGP

SEQ ID NO: 1383703 - protein, 9 aa, Homo Sapiens
PDDNKPPIQ

SEQ ID NO: 1383704 - protein, 9 aa, Homo Sapiens
TVLDEEVGA

SEQ ID NO: 1383705 - protein, 9 aa, Homo Sapiens
TKHLFRELM

SEQ ID NO: 1383706 - protein, 9 aa, Homo Sapiens
AQLVVRLGL

SEQ ID NO: 1383707 - protein, 9 aa, Homo Sapiens
HNSNANIIT

SEQ ID NO: 1383708 - protein, 9 aa, Homo Sapiens
PSTQFHSLR

SEQ ID NO: 1383709 - protein, 9 aa, Homo Sapiens
HFQNKVLIK

SEQ ID NO: 1383710 - protein, 9 aa, Homo Sapiens
LLLEVIRCC

SEQ ID NO: 1383711 - protein, 9 aa, Homo Sapiens
SRSGSRKCK

SEQ ID NO: 1383712 - protein, 9 aa, Homo Sapiens
KLKKNISSG

SEQ ID NO: 1383713 - protein, 9 aa, Homo Sapiens
WMPDQLYRT

SEQ ID NO: 1383714 - protein, 9 aa, Homo Sapiens
KVHFFVLTK

SEQ ID NO: 1383715 - protein, 9 aa, Homo Sapiens
TSFIIRSLQ

SEQ ID NO: 1383716 - protein, 9 aa, Homo Sapiens
LTGVYALII

SEQ ID NO: 1383717 - protein, 9 aa, Homo Sapiens
LDEEVGAAG

SEQ ID NO: 1383718 - protein, 9 aa, Homo Sapiens
LFSFQMHIK

SEQ ID NO: 1383719 - protein, 9 aa, Homo Sapiens
KKTSFIIRS

SEQ ID NO: 1383720 - protein, 9 aa, Homo Sapiens
LVKISCVIR

SEQ ID NO: 1383721 - protein, 9 aa, Homo Sapiens
GMNSHVPDC

SEQ ID NO: 1383722 - protein, 9 aa, Homo Sapiens
ENQEQGKHK

SEQ ID NO: 1383723 - protein, 9 aa, Homo Sapiens
MPELVDTHI

SEQ ID NO: 1383724 - protein, 9 aa, Homo Sapiens
SELSKKRKP

SEQ ID NO: 1383725 - protein, 9 aa, Homo Sapiens
GSGMEMEEM

SEQ ID NO: 1383726 - protein, 9 aa, Homo Sapiens
HPSRSPLWT

SEQ ID NO: 1383727 - protein, 9 aa, Homo Sapiens
QNSTDMIKM

SEQ ID NO: 1383728 - protein, 9 aa, Homo Sapiens
TTSLFSNIE

SEQ ID NO: 1383729 - protein, 9 aa, Homo Sapiens
KKALAAGDY

SEQ ID NO: 1383730 - protein, 9 aa, Homo Sapiens
KKTYEDPYW

SEQ ID NO: 1383731 - protein, 9 aa, Homo Sapiens
LLLDANKIN

SEQ ID NO: 1383732 - protein, 9 aa, Homo Sapiens
EWCWGDISR

SEQ ID NO: 1383733 - protein, 9 aa, Homo Sapiens
GRLMTRSLV

SEQ ID NO: 1383734 - protein, 9 aa, Homo Sapiens
AGSARVGTW

SEQ ID NO: 1383735 - protein, 9 aa, Homo Sapiens
VLDRQGWGW

SEQ ID NO: 1383736 - protein, 9 aa, Homo Sapiens
SSSGCTSSS

SEQ ID NO: 1383737 - protein, 9 aa, Homo Sapiens
LQRLLHPPS

SEQ ID NO: 1383738 - protein, 9 aa, Homo Sapiens
QEPTLPFEV

SEQ ID NO: 1383739 - protein, 9 aa, Homo Sapiens
RRGAGVSPL

SEQ ID NO: 1383740 - protein, 9 aa, Homo Sapiens
AEPLWKELS

SEQ ID NO: 1383741 - protein, 9 aa, Homo Sapiens
QHAADLLRE

SEQ ID NO: 1383742 - protein, 9 aa, Homo Sapiens
AVDGTFILS

SEQ ID NO: 1383743 - protein, 9 aa, Homo Sapiens
DEYLNKVIK

SEQ ID NO: 1383744 - protein, 9 aa, Homo Sapiens
ISCPFQSPT

SEQ ID NO: 1383745 - protein, 9 aa, Homo Sapiens
LLVGAPCFL

SEQ ID NO: 1383746 - protein, 9 aa, Homo Sapiens
QQDSGSKPR

SEQ ID NO: 1383747 - protein, 9 aa, Homo Sapiens
MCSWLFQHL

SEQ ID NO: 1383748 - protein, 9 aa, Homo Sapiens
DESFNPSLW

SEQ ID NO: 1383749 - protein, 9 aa, Homo Sapiens
SCVNCVQGV

SEQ ID NO: 1383750 - protein, 9 aa, Homo Sapiens
LEARAPHVC

SEQ ID NO: 1383751 - protein, 9 aa, Homo Sapiens
ALHEHSNPN

SEQ ID NO: 1383752 - protein, 9 aa, Homo Sapiens
PGMQGARGL

SEQ ID NO: 1383753 - protein, 9 aa, Homo Sapiens
PPAPAPWLP

SEQ ID NO: 1383754 - protein, 9 aa, Homo Sapiens
SCSTPPCWW

SEQ ID NO: 1383755 - protein, 9 aa, Homo Sapiens
ELQPALTLE

SEQ ID NO: 1383756 - protein, 9 aa, Homo Sapiens
SVIFAIGPV

SEQ ID NO: 1383757 - protein, 9 aa, Homo Sapiens
HHTDHPRAQ

SEQ ID NO: 1383758 - protein, 9 aa, Homo Sapiens
AGGGAERSH

SEQ ID NO: 1383759 - protein, 9 aa, Homo Sapiens
LVSQVIIAM

SEQ ID NO: 1383760 - protein, 9 aa, Homo Sapiens
PPLPTASGL

SEQ ID NO: 1383761 - protein, 9 aa, Homo Sapiens
WLPIPVRPM

SEQ ID NO: 1383762 - protein, 9 aa, Homo Sapiens
NLKSCIKWL

SEQ ID NO: 1383763 - protein, 9 aa, Homo Sapiens
QGVPLSPCR

SEQ ID NO: 1383764 - protein, 9 aa, Homo Sapiens
TDFGTYICV

SEQ ID NO: 1383765 - protein, 9 aa, Homo Sapiens
NRVLEVKKP

SEQ ID NO: 1383766 - protein, 8 aa, Homo Sapiens
DSIGSSGL

SEQ ID NO: 1383767 - protein, 9 aa, Homo Sapiens
DGITNLPRL

SEQ ID NO: 1383768 - protein, 9 aa, Homo Sapiens
QDLFRIVFQ

SEQ ID NO: 1383769 - protein, 9 aa, Homo Sapiens
PTGSEADGL

SEQ ID NO: 1383770 - protein, 9 aa, Homo Sapiens
MDQQGQGSH

SEQ ID NO: 1383771 - protein, 9 aa, Homo Sapiens
LPGSQQQLY

SEQ ID NO: 1383772 - protein, 9 aa, Homo Sapiens
VKKRKKREK

SEQ ID NO: 1383773 - protein, 9 aa, Homo Sapiens
FFSVELMDH

SEQ ID NO: 1383774 - protein, 9 aa, Homo Sapiens
FSPGHSLET

SEQ ID NO: 1383775 - protein, 9 aa, Homo Sapiens
IMSTTGWLE

SEQ ID NO: 1383776 - protein, 9 aa, Homo Sapiens
VRKPHPGQQ

SEQ ID NO: 1383777 - protein, 9 aa, Homo Sapiens
CGAVREQHG

SEQ ID NO: 1383778 - protein, 9 aa, Homo Sapiens
AGYKQEVAQ

SEQ ID NO: 1383779 - protein, 9 aa, Homo Sapiens
THWLRPTSG

SEQ ID NO: 1383780 - protein, 9 aa, Homo Sapiens
AFSFPWGTL

SEQ ID NO: 1383781 - protein, 9 aa, Homo Sapiens
SMLTDSGNV

SEQ ID NO: 1383782 - protein, 9 aa, Homo Sapiens
ERLNNPPGV

SEQ ID NO: 1383783 - protein, 9 aa, Homo Sapiens
EHFSPFRIQ

SEQ ID NO: 1383784 - protein, 9 aa, Homo Sapiens
AATSASGAF

SEQ ID NO: 1383785 - protein, 9 aa, Homo Sapiens
LEALSEGLF

SEQ ID NO: 1383786 - protein, 9 aa, Homo Sapiens
LLWMSESPE

SEQ ID NO: 1383787 - protein, 9 aa, Homo Sapiens
APLPERAGA

SEQ ID NO: 1383788 - protein, 9 aa, Homo Sapiens
TAWKTKKTS

SEQ ID NO: 1383789 - protein, 9 aa, Homo Sapiens
SGTLGLVVS

SEQ ID NO: 1383790 - protein, 9 aa, Homo Sapiens
IVTQTPHYI

SEQ ID NO: 1383791 - protein, 9 aa, Homo Sapiens
ENSMLTDSG

SEQ ID NO: 1383792 - protein, 9 aa, Homo Sapiens
LQGFLILPG

SEQ ID NO: 1383793 - protein, 9 aa, Homo Sapiens
VIATGNREL

SEQ ID NO: 1383794 - protein, 9 aa, Homo Sapiens
VMLDDEEEG

SEQ ID NO: 1383795 - protein, 9 aa, Homo Sapiens
GLLVIATGN

SEQ ID NO: 1383796 - protein, 9 aa, Homo Sapiens
MNKMRDNKY

SEQ ID NO: 1383797 - protein, 9 aa, Homo Sapiens
SRFGLFHID

SEQ ID NO: 1383798 - protein, 9 aa, Homo Sapiens
WGESPWQVM

SEQ ID NO: 1383799 - protein, 9 aa, Homo Sapiens
KLPPAPAPW

SEQ ID NO: 1383800 - protein, 9 aa, Homo Sapiens
MCSMKKTIG

SEQ ID NO: 1383801 - protein, 9 aa, Homo Sapiens
SSPRISVCG

SEQ ID NO: 1383802 - protein, 9 aa, Homo Sapiens
TVQAFLKRK

SEQ ID NO: 1383803 - protein, 9 aa, Homo Sapiens
IYTHIYIHT

SEQ ID NO: 1383804 - protein, 9 aa, Homo Sapiens
YEDGKLLCR

SEQ ID NO: 1383805 - protein, 9 aa, Homo Sapiens
SSLSQNDAY

SEQ ID NO: 1383806 - protein, 9 aa, Homo Sapiens
TSRILDAKS

SEQ ID NO: 1383807 - protein, 9 aa, Homo Sapiens
FGNSAMSQP

SEQ ID NO: 1383808 - protein, 9 aa, Homo Sapiens
MILTPIEAY

SEQ ID NO: 1383809 - protein, 9 aa, Homo Sapiens
KNTRVENVN

SEQ ID NO: 1383810 - protein, 9 aa, Homo Sapiens
KETPIEWEI

SEQ ID NO: 1383811 - protein, 9 aa, Homo Sapiens
NGDFQMVYF

SEQ ID NO: 1383812 - protein, 9 aa, Homo Sapiens
VGDPKIGVA

SEQ ID NO: 1383813 - protein, 9 aa, Homo Sapiens
SNRGDAAGP

SEQ ID NO: 1383814 - protein, 9 aa, Homo Sapiens
PDMATSQVT

SEQ ID NO: 1383815 - protein, 9 aa, Homo Sapiens
LQSECQKTV

SEQ ID NO: 1383816 - protein, 9 aa, Homo Sapiens
PKNLVACPD

SEQ ID NO: 1383817 - protein, 9 aa, Homo Sapiens
VIPKDEKLD

SEQ ID NO: 1383818 - protein, 9 aa, Homo Sapiens
SGQGKKKPY

SEQ ID NO: 1383819 - protein, 9 aa, Homo Sapiens
SSKDSLTCF

SEQ ID NO: 1383820 - protein, 9 aa, Homo Sapiens
DSSAYESCM

SEQ ID NO: 1383821 - protein, 9 aa, Homo Sapiens
MFLNLLSPH

SEQ ID NO: 1383822 - protein, 9 aa, Homo Sapiens
NVQDYEVMM

SEQ ID NO: 1383823 - protein, 9 aa, Homo Sapiens
AEKPKHHYS

SEQ ID NO: 1383824 - protein, 9 aa, Homo Sapiens
DQWFSTPWS

SEQ ID NO: 1383825 - protein, 9 aa, Homo Sapiens
EPPLPTASG

SEQ ID NO: 1383826 - protein, 9 aa, Homo Sapiens
MCPLWRSTG

SEQ ID NO: 1383827 - protein, 9 aa, Homo Sapiens
VLVPQSPPM

SEQ ID NO: 1383828 - protein, 9 aa, Homo Sapiens
DDIDRMLQE

SEQ ID NO: 1383829 - protein, 9 aa, Homo Sapiens
TTQVNAWDH

SEQ ID NO: 1383830 - protein, 9 aa, Homo Sapiens
TPWTLLILT

SEQ ID NO: 1383831 - protein, 9 aa, Homo Sapiens
GEAALWCGH

SEQ ID NO: 1383832 - protein, 9 aa, Homo Sapiens
GSNRGDAAG

SEQ ID NO: 1383833 - protein, 9 aa, Homo Sapiens
GQISTLVLD

SEQ ID NO: 1383834 - protein, 9 aa, Homo Sapiens
WVSVVTPAQ

SEQ ID NO: 1383835 - protein, 9 aa, Homo Sapiens
TWLTAWTCH

SEQ ID NO: 1383836 - protein, 9 aa, Homo Sapiens
KVKLRMSFL

SEQ ID NO: 1383837 - protein, 9 aa, Homo Sapiens
RSIELRIKR

SEQ ID NO: 1383838 - protein, 9 aa, Homo Sapiens
LHKLCCGSS

SEQ ID NO: 1383839 - protein, 9 aa, Homo Sapiens
TLFPRPERY

SEQ ID NO: 1383840 - protein, 9 aa, Homo Sapiens
QGVAAPPLT

SEQ ID NO: 1383841 - protein, 9 aa, Homo Sapiens
NIDFRTQES

SEQ ID NO: 1383842 - protein, 9 aa, Homo Sapiens
VRENNSPPC

SEQ ID NO: 1383843 - protein, 9 aa, Homo Sapiens
PTASGLKNI

SEQ ID NO: 1383844 - protein, 9 aa, Homo Sapiens
TPSPLTCRC

SEQ ID NO: 1383845 - protein, 9 aa, Homo Sapiens
MPASKKCRV

SEQ ID NO: 1383846 - protein, 9 aa, Homo Sapiens
SAIVSISAL

SEQ ID NO: 1383847 - protein, 9 aa, Homo Sapiens
DEEAQGSGE

SEQ ID NO: 1383848 - protein, 9 aa, Homo Sapiens
PKLFSSTVL

SEQ ID NO: 1383849 - protein, 9 aa, Homo Sapiens
TCGSCKVFK

SEQ ID NO: 1383850 - protein, 9 aa, Homo Sapiens
VAAFFTFSL

SEQ ID NO: 1383851 - protein, 9 aa, Homo Sapiens
LPRAFKVPL

SEQ ID NO: 1383852 - protein, 9 aa, Homo Sapiens
WVSLLGLLI

SEQ ID NO: 1383853 - protein, 9 aa, Homo Sapiens
APFFVPMSL

SEQ ID NO: 1383854 - protein, 9 aa, Homo Sapiens
LASVGATGR

SEQ ID NO: 1383855 - protein, 9 aa, Homo Sapiens
VWASAIAQD

SEQ ID NO: 1383856 - protein, 9 aa, Homo Sapiens
NLCLDERQI

SEQ ID NO: 1383857 - protein, 9 aa, Homo Sapiens
LKGKRSHLW

SEQ ID NO: 1383858 - protein, 9 aa, Homo Sapiens
LYLKKKTRT

SEQ ID NO: 1383859 - protein, 9 aa, Homo Sapiens
GDYDVEKNN

SEQ ID NO: 1383860 - protein, 9 aa, Homo Sapiens
SELHLATAW

SEQ ID NO: 1383861 - protein, 9 aa, Homo Sapiens
APTPRSPTR

SEQ ID NO: 1383862 - protein, 9 aa, Homo Sapiens
LTIRKEEDG

SEQ ID NO: 1383863 - protein, 9 aa, Homo Sapiens
ITSIFLIPS

SEQ ID NO: 1383864 - protein, 9 aa, Homo Sapiens
IMCSWLFQH

SEQ ID NO: 1383865 - protein, 9 aa, Homo Sapiens
IRQQIPEKK

SEQ ID NO: 1383866 - protein, 9 aa, Homo Sapiens
DLVKNVLKS

SEQ ID NO: 1383867 - protein, 9 aa, Homo Sapiens
TGVYALIIF

SEQ ID NO: 1383868 - protein, 9 aa, Homo Sapiens
LLLVYIMST

SEQ ID NO: 1383869 - protein, 9 aa, Homo Sapiens
LLILTTLSW

SEQ ID NO: 1383870 - protein, 9 aa, Homo Sapiens
RILLQRNLL

SEQ ID NO: 1383871 - protein, 9 aa, Homo Sapiens
KCPKHVNLC

SEQ ID NO: 1383872 - protein, 9 aa, Homo Sapiens
GPTPTEPPL

SEQ ID NO: 1383873 - protein, 9 aa, Homo Sapiens
GAGKLPHHM

SEQ ID NO: 1383874 - protein, 9 aa, Homo Sapiens
ITTIFMAQK

SEQ ID NO: 1383875 - protein, 9 aa, Homo Sapiens
MGLRPWWMP

SEQ ID NO: 1383876 - protein, 9 aa, Homo Sapiens
RGIDKIYVR

SEQ ID NO: 1383877 - protein, 9 aa, Homo Sapiens
GACATCSWM

SEQ ID NO: 1383878 - protein, 9 aa, Homo Sapiens
EDGEEGGCA

SEQ ID NO: 1383879 - protein, 9 aa, Homo Sapiens
TCQVRATGK

SEQ ID NO: 1383880 - protein, 9 aa, Homo Sapiens
RSTTTPPHC

SEQ ID NO: 1383881 - protein, 9 aa, Homo Sapiens
PRISVCGCL

SEQ ID NO: 1383882 - protein, 9 aa, Homo Sapiens
AVPSSCTYS

SEQ ID NO: 1383883 - protein, 9 aa, Homo Sapiens
LHITSLAGQ

SEQ ID NO: 1383884 - protein, 9 aa, Homo Sapiens
PSYNIKSVC

SEQ ID NO: 1383885 - protein, 9 aa, Homo Sapiens
TTPPHCSPA

SEQ ID NO: 1383886 - protein, 9 aa, Homo Sapiens
SCSHRRRAK

SEQ ID NO: 1383887 - protein, 9 aa, Homo Sapiens
PSSIPNLKS

SEQ ID NO: 1383888 - protein, 9 aa, Homo Sapiens
PSTDLKIRG

SEQ ID NO: 1383889 - protein, 9 aa, Homo Sapiens
LEDGEEGGC

SEQ ID NO: 1383890 - protein, 9 aa, Homo Sapiens
PQWLRATWG

SEQ ID NO: 1383891 - protein, 9 aa, Homo Sapiens
GRPGHRHPQ

SEQ ID NO: 1383892 - protein, 9 aa, Homo Sapiens
SSSLYVSPS

SEQ ID NO: 1383893 - protein, 9 aa, Homo Sapiens
RQQIPEKKP

SEQ ID NO: 1383894 - protein, 9 aa, Homo Sapiens
SLCSHRGLS

SEQ ID NO: 1383895 - protein, 9 aa, Homo Sapiens
WSVRITIHW

SEQ ID NO: 1383896 - protein, 9 aa, Homo Sapiens
VFTIWLIYS

SEQ ID NO: 1383897 - protein, 9 aa, Homo Sapiens
DVQSLLAPG

SEQ ID NO: 1383898 - protein, 9 aa, Homo Sapiens
VWYNIIGPL

SEQ ID NO: 1383899 - protein, 9 aa, Homo Sapiens
HSLRRDGPS

SEQ ID NO: 1383900 - protein, 9 aa, Homo Sapiens
MMPASQTQI

SEQ ID NO: 1383901 - protein, 9 aa, Homo Sapiens
ISSVQKKMK

SEQ ID NO: 1383902 - protein, 9 aa, Homo Sapiens
VSEGGPEAP

SEQ ID NO: 1383903 - protein, 9 aa, Homo Sapiens
DDEEEEEMM

SEQ ID NO: 1383904 - protein, 9 aa, Homo Sapiens
ATQMQSFGM

SEQ ID NO: 1383905 - protein, 9 aa, Homo Sapiens
QMLLSSLSQ

SEQ ID NO: 1383906 - protein, 9 aa, Homo Sapiens
CDWRFANSS

SEQ ID NO: 1383907 - protein, 9 aa, Homo Sapiens
PWASSAPSS

SEQ ID NO: 1383908 - protein, 9 aa, Homo Sapiens
KTTSLFSNI

SEQ ID NO: 1383909 - protein, 9 aa, Homo Sapiens
TYITLKRIF

SEQ ID NO: 1383910 - protein, 9 aa, Homo Sapiens
GDLAATVQM

SEQ ID NO: 1383911 - protein, 9 aa, Homo Sapiens
VTLASQFLS

SEQ ID NO: 1383912 - protein, 9 aa, Homo Sapiens
VKISCVIRT

SEQ ID NO: 1383913 - protein, 9 aa, Homo Sapiens
ISGFSLFFG

SEQ ID NO: 1383914 - protein, 9 aa, Homo Sapiens
VGQVLKGTF

SEQ ID NO: 1383915 - protein, 9 aa, Homo Sapiens
NMDRETKEE

SEQ ID NO: 1383916 - protein, 9 aa, Homo Sapiens
HLFRELMGD

SEQ ID NO: 1383917 - protein, 9 aa, Homo Sapiens
LLGDAHVLP

SEQ ID NO: 1383918 - protein, 9 aa, Homo Sapiens
GKELLQKTI

SEQ ID NO: 1383919 - protein, 9 aa, Homo Sapiens
GKIPDKEVR

SEQ ID NO: 1383920 - protein, 9 aa, Homo Sapiens
AVCVVYTGD

SEQ ID NO: 1383921 - protein, 9 aa, Homo Sapiens
LMTRSLVLR

SEQ ID NO: 1383922 - protein, 9 aa, Homo Sapiens
EYLSPQRSS

SEQ ID NO: 1383923 - protein, 9 aa, Homo Sapiens
SMDLFSSCT

SEQ ID NO: 1383924 - protein, 9 aa, Homo Sapiens
HKLILDHNP

SEQ ID NO: 1383925 - protein, 9 aa, Homo Sapiens
TQPDDNKPP

SEQ ID NO: 1383926 - protein, 9 aa, Homo Sapiens
MRRRSQRRR

SEQ ID NO: 1383927 - protein, 9 aa, Homo Sapiens
HAAALPGQP

SEQ ID NO: 1383928 - protein, 9 aa, Homo Sapiens
DLTYSVKQD

SEQ ID NO: 1383929 - protein, 9 aa, Homo Sapiens
LGRCGCSPS

SEQ ID NO: 1383930 - protein, 9 aa, Homo Sapiens
ANITATRTS

SEQ ID NO: 1383931 - protein, 9 aa, Homo Sapiens
EWYNDSVEH

SEQ ID NO: 1383932 - protein, 9 aa, Homo Sapiens
EKECFESLR

SEQ ID NO: 1383933 - protein, 9 aa, Homo Sapiens
VPDMATSQV

SEQ ID NO: 1383934 - protein, 9 aa, Homo Sapiens
VLECMLKKT

SEQ ID NO: 1383935 - protein, 9 aa, Homo Sapiens
RWGTLRFVA

SEQ ID NO: 1383936 - protein, 9 aa, Homo Sapiens
LLTQARPRN

SEQ ID NO: 1383937 - protein, 9 aa, Homo Sapiens
APGRVAEPA

SEQ ID NO: 1383938 - protein, 9 aa, Homo Sapiens
CDKKRGASS

SEQ ID NO: 1383939 - protein, 9 aa, Homo Sapiens
LEEAVDSVG

SEQ ID NO: 1383940 - protein, 9 aa, Homo Sapiens
RCIPNTFKY

SEQ ID NO: 1383941 - protein, 9 aa, Homo Sapiens
SDRPSVSIS

SEQ ID NO: 1383942 - protein, 9 aa, Homo Sapiens
GLHSFYHTG

SEQ ID NO: 1383943 - protein, 9 aa, Homo Sapiens
RPTGWEEED

SEQ ID NO: 1383944 - protein, 9 aa, Homo Sapiens
TIVPLTMGW

SEQ ID NO: 1383945 - protein, 9 aa, Homo Sapiens
WHPGSWPVA

SEQ ID NO: 1383946 - protein, 9 aa, Homo Sapiens
NPEENDTTL

SEQ ID NO: 1383947 - protein, 9 aa, Homo Sapiens
GAGRYFLWV

SEQ ID NO: 1383948 - protein, 9 aa, Homo Sapiens
LPKQPDLRG

SEQ ID NO: 1383949 - protein, 9 aa, Homo Sapiens
EKRGSRSKT

SEQ ID NO: 1383950 - protein, 9 aa, Homo Sapiens
KMSRISGFG

SEQ ID NO: 1383951 - protein, 9 aa, Homo Sapiens
CAQWSPVVR

SEQ ID NO: 1383952 - protein, 9 aa, Homo Sapiens
QDGPCGTVL

SEQ ID NO: 1383953 - protein, 9 aa, Homo Sapiens
CQKRAPINS

SEQ ID NO: 1383954 - protein, 9 aa, Homo Sapiens
NGSLLLTQA

SEQ ID NO: 1383955 - protein, 9 aa, Homo Sapiens
RRFSSCRRD

SEQ ID NO: 1383956 - protein, 9 aa, Homo Sapiens
SIISTQVSP

SEQ ID NO: 1383957 - protein, 9 aa, Homo Sapiens
GCDWRFANS

SEQ ID NO: 1383958 - protein, 9 aa, Homo Sapiens
TTLQELLNR

SEQ ID NO: 1383959 - protein, 9 aa, Homo Sapiens
ENVNPYEVK

SEQ ID NO: 1383960 - protein, 9 aa, Homo Sapiens
IRQHSLGPS

SEQ ID NO: 1383961 - protein, 9 aa, Homo Sapiens
MEIMSHYRH

SEQ ID NO: 1383962 - protein, 9 aa, Homo Sapiens
YAMKILHKA

SEQ ID NO: 1383963 - protein, 9 aa, Homo Sapiens
EEERCKKRD

SEQ ID NO: 1383964 - protein, 9 aa, Homo Sapiens
FSGVPTQLV

SEQ ID NO: 1383965 - protein, 9 aa, Homo Sapiens
AIGPVGNLL

SEQ ID NO: 1383966 - protein, 9 aa, Homo Sapiens
EFEKLSAGQ

SEQ ID NO: 1383967 - protein, 9 aa, Homo Sapiens
LVVLDVDTI

SEQ ID NO: 1383968 - protein, 9 aa, Homo Sapiens
QVSFSGVPT

SEQ ID NO: 1383969 - protein, 9 aa, Homo Sapiens
VNMVGCLAW

SEQ ID NO: 1383970 - protein, 9 aa, Homo Sapiens
VLRFKVLLM

SEQ ID NO: 1383971 - protein, 9 aa, Homo Sapiens
PPGLLVIAT

SEQ ID NO: 1383972 - protein, 9 aa, Homo Sapiens
RNALWVAAL

SEQ ID NO: 1383973 - protein, 9 aa, Homo Sapiens
DNNHCQMSG

SEQ ID NO: 1383974 - protein, 9 aa, Homo Sapiens
VGGISPPFP

SEQ ID NO: 1383975 - protein, 9 aa, Homo Sapiens
GDEVFDRKK

SEQ ID NO: 1383976 - protein, 9 aa, Homo Sapiens
AVLYLKKKT

SEQ ID NO: 1383977 - protein, 9 aa, Homo Sapiens
REQHGIQRV

SEQ ID NO: 1383978 - protein, 9 aa, Homo Sapiens
DRSVHNLTE

SEQ ID NO: 1383979 - protein, 9 aa, Homo Sapiens
ETYVKLDRL

SEQ ID NO: 1383980 - protein, 9 aa, Homo Sapiens
CPVWYNIIG

SEQ ID NO: 1383981 - protein, 9 aa, Homo Sapiens
ITEDLTSQE

SEQ ID NO: 1383982 - protein, 9 aa, Homo Sapiens
GPGRSQVSG

SEQ ID NO: 1383983 - protein, 9 aa, Homo Sapiens
MTKFHEMVT

SEQ ID NO: 1383984 - protein, 9 aa, Homo Sapiens
LLVALPPVT

SEQ ID NO: 1383985 - protein, 9 aa, Homo Sapiens
APDLVLNVE

SEQ ID NO: 1383986 - protein, 9 aa, Homo Sapiens
KCIGVTNHC

SEQ ID NO: 1383987 - protein, 9 aa, Homo Sapiens
ACSITVSFV

SEQ ID NO: 1383988 - protein, 9 aa, Homo Sapiens
QPCIQIIEQ

SEQ ID NO: 1383989 - protein, 9 aa, Homo Sapiens
AMRCAIWLA

SEQ ID NO: 1383990 - protein, 9 aa, Homo Sapiens
VMLDLAGSI

SEQ ID NO: 1383991 - protein, 9 aa, Homo Sapiens
HTSYREEEP

SEQ ID NO: 1383992 - protein, 9 aa, Homo Sapiens
VGRFGGRGT

SEQ ID NO: 1383993 - protein, 9 aa, Homo Sapiens
GQVLPGLDV

SEQ ID NO: 1383994 - protein, 9 aa, Homo Sapiens
RIDETKHSV

SEQ ID NO: 1383995 - protein, 9 aa, Homo Sapiens
KPRHKNKDM

SEQ ID NO: 1383996 - protein, 9 aa, Homo Sapiens
PCVPILKSL

SEQ ID NO: 1383997 - protein, 9 aa, Homo Sapiens
QPPGGCHPA

SEQ ID NO: 1383998 - protein, 9 aa, Homo Sapiens
SLLSTLSQP

SEQ ID NO: 1383999 - protein, 9 aa, Homo Sapiens
VTAKKVYVT

SEQ ID NO: 1384000 - protein, 9 aa, Homo Sapiens
DILLIVRLA

SEQ ID NO: 1384001 - protein, 9 aa, Homo Sapiens
NRRLKSMPW

SEQ ID NO: 1384002 - protein, 9 aa, Homo Sapiens
EVGGPGQSA

SEQ ID NO: 1384003 - protein, 9 aa, Homo Sapiens
HTDHPRAQC

SEQ ID NO: 1384004 - protein, 9 aa, Homo Sapiens
SKDDIDRML

SEQ ID NO: 1384005 - protein, 9 aa, Homo Sapiens
PWTLRMQRF

SEQ ID NO: 1384006 - protein, 9 aa, Homo Sapiens
GDPDAVVAS

SEQ ID NO: 1384007 - protein, 9 aa, Homo Sapiens
VQDGAAEEE

SEQ ID NO: 1384008 - protein, 9 aa, Homo Sapiens
VGKARRRNA

SEQ ID NO: 1384009 - protein, 9 aa, Homo Sapiens
ECCSSWLRR

SEQ ID NO: 1384010 - protein, 9 aa, Homo Sapiens
ASSQNWGSL

SEQ ID NO: 1384011 - protein, 9 aa, Homo Sapiens
DLAATVQMV

SEQ ID NO: 1384012 - protein, 9 aa, Homo Sapiens
LYHWHPSCL

SEQ ID NO: 1384013 - protein, 9 aa, Homo Sapiens
VTNHCDGVF

SEQ ID NO: 1384014 - protein, 9 aa, Homo Sapiens
VMLPSCKMT

SEQ ID NO: 1384015 - protein, 9 aa, Homo Sapiens
SRLPRMPGP

SEQ ID NO: 1384016 - protein, 9 aa, Homo Sapiens
LMLPPIFGD

SEQ ID NO: 1384017 - protein, 9 aa, Homo Sapiens
CLHPDVAHL

SEQ ID NO: 1384018 - protein, 9 aa, Homo Sapiens
GAHAWLCHL

SEQ ID NO: 1384019 - protein, 9 aa, Homo Sapiens
IPQQCIILS

SEQ ID NO: 1384020 - protein, 9 aa, Homo Sapiens
ASGLKNIPG

SEQ ID NO: 1384021 - protein, 9 aa, Homo Sapiens
SGCTSSSMS

SEQ ID NO: 1384022 - protein, 9 aa, Homo Sapiens
NKEAICKAG

SEQ ID NO: 1384023 - protein, 9 aa, Homo Sapiens
AEPAVAAPS

SEQ ID NO: 1384024 - protein, 9 aa, Homo Sapiens
NVEKRRQNH

SEQ ID NO: 1384025 - protein, 9 aa, Homo Sapiens
ASLMGLCVD

SEQ ID NO: 1384026 - protein, 9 aa, Homo Sapiens
RPQRKGVCV

SEQ ID NO: 1384027 - protein, 9 aa, Homo Sapiens
INDPWKNPA

SEQ ID NO: 1384028 - protein, 9 aa, Homo Sapiens
SEKKFLKIL

SEQ ID NO: 1384029 - protein, 9 aa, Homo Sapiens
TKSGTHSPA

SEQ ID NO: 1384030 - protein, 9 aa, Homo Sapiens
IASIKPIIS

SEQ ID NO: 1384031 - protein, 9 aa, Homo Sapiens
PPPRPPWAL

SEQ ID NO: 1384032 - protein, 9 aa, Homo Sapiens
WTRCLRMRP

SEQ ID NO: 1384033 - protein, 9 aa, Homo Sapiens
IVYKLRRKN

SEQ ID NO: 1384034 - protein, 9 aa, Homo Sapiens
AGRMGGRHP

SEQ ID NO: 1384035 - protein, 9 aa, Homo Sapiens
AKEVLKKQL

SEQ ID NO: 1384036 - protein, 9 aa, Homo Sapiens
GSCPSLYWE

SEQ ID NO: 1384037 - protein, 9 aa, Homo Sapiens
EAQKKLYEE

SEQ ID NO: 1384038 - protein, 9 aa, Homo Sapiens
AGFGHGLHR

SEQ ID NO: 1384039 - protein, 9 aa, Homo Sapiens
KWRKCPKHV

SEQ ID NO: 1384040 - protein, 9 aa, Homo Sapiens
PGAVHLAFS

SEQ ID NO: 1384041 - protein, 9 aa, Homo Sapiens
MWRPALGGV

SEQ ID NO: 1384042 - protein, 9 aa, Homo Sapiens
YIIFFSPGI

SEQ ID NO: 1384043 - protein, 9 aa, Homo Sapiens
DTVQRTGRT

SEQ ID NO: 1384044 - protein, 9 aa, Homo Sapiens
EGFLLEGAG

SEQ ID NO: 1384045 - protein, 9 aa, Homo Sapiens
TWTTTSCMW

SEQ ID NO: 1384046 - protein, 9 aa, Homo Sapiens
YRSCALSYG

SEQ ID NO: 1384047 - protein, 9 aa, Homo Sapiens
TDILLIVRL

SEQ ID NO: 1384048 - protein, 9 aa, Homo Sapiens
PRKKEEDWK

SEQ ID NO: 1384049 - protein, 9 aa, Homo Sapiens
CKMTGKIIL

SEQ ID NO: 1384050 - protein, 9 aa, Homo Sapiens
LAFSPGHSL

SEQ ID NO: 1384051 - protein, 9 aa, Homo Sapiens
WQLLRLKQM

SEQ ID NO: 1384052 - protein, 9 aa, Homo Sapiens
SSNILILEK

SEQ ID NO: 1384053 - protein, 9 aa, Homo Sapiens
FVASLWGGP

SEQ ID NO: 1384054 - protein, 9 aa, Homo Sapiens
VTWEVPFAD

SEQ ID NO: 1384055 - protein, 9 aa, Homo Sapiens
EGKRKEWQR

SEQ ID NO: 1384056 - protein, 9 aa, Homo Sapiens
DFNREKMPL

SEQ ID NO: 1384057 - protein, 9 aa, Homo Sapiens
PHTPSHHPA

SEQ ID NO: 1384058 - protein, 9 aa, Homo Sapiens
GVEIHCEEK

SEQ ID NO: 1384059 - protein, 9 aa, Homo Sapiens
LHSRRMSVR

SEQ ID NO: 1384060 - protein, 9 aa, Homo Sapiens
SLYWEWPAV

SEQ ID NO: 1384061 - protein, 9 aa, Homo Sapiens
FLSSSTHLP

SEQ ID NO: 1384062 - protein, 9 aa, Homo Sapiens
GQGFHDETA

SEQ ID NO: 1384063 - protein, 9 aa, Homo Sapiens
DETKHSVLQ

SEQ ID NO: 1384064 - protein, 9 aa, Homo Sapiens
GSSCCGRAP

SEQ ID NO: 1384065 - protein, 9 aa, Homo Sapiens
PSTPTQYIA

SEQ ID NO: 1384066 - protein, 9 aa, Homo Sapiens
MLPPIFGDL

SEQ ID NO: 1384067 - protein, 9 aa, Homo Sapiens
RAAALQSGR

SEQ ID NO: 1384068 - protein, 9 aa, Homo Sapiens
TWTAPRGPA

SEQ ID NO: 1384069 - protein, 9 aa, Homo Sapiens
VIDLKKEWL

SEQ ID NO: 1384070 - protein, 9 aa, Homo Sapiens
IENSERKGL

SEQ ID NO: 1384071 - protein, 9 aa, Homo Sapiens
SLVCVTTIA

SEQ ID NO: 1384072 - protein, 9 aa, Homo Sapiens
RTTASALTL

SEQ ID NO: 1384073 - protein, 9 aa, Homo Sapiens
DHTSPEEEP

SEQ ID NO: 1384074 - protein, 9 aa, Homo Sapiens
SGVEIHCEE

SEQ ID NO: 1384075 - protein, 9 aa, Homo Sapiens
PTLPLPLVT

SEQ ID NO: 1384076 - protein, 9 aa, Homo Sapiens
ETHCTVAVP

SEQ ID NO: 1384077 - protein, 9 aa, Homo Sapiens
DVGIWYLFH

SEQ ID NO: 1384078 - protein, 9 aa, Homo Sapiens
GAPLPERAG

SEQ ID NO: 1384079 - protein, 9 aa, Homo Sapiens
YDGRNALWV

SEQ ID NO: 1384080 - protein, 9 aa, Homo Sapiens
SGGVVDNNH

SEQ ID NO: 1384081 - protein, 9 aa, Homo Sapiens
VHHKRMHSS

SEQ ID NO: 1384082 - protein, 9 aa, Homo Sapiens
SMHILSSCC

SEQ ID NO: 1384083 - protein, 9 aa, Homo Sapiens
MAGRPGHRH

SEQ ID NO: 1384084 - protein, 9 aa, Homo Sapiens
TLRCPAVPA

SEQ ID NO: 1384085 - protein, 9 aa, Homo Sapiens
LLCLINYYE

SEQ ID NO: 1384086 - protein, 9 aa, Homo Sapiens
DQEPDGDYQ

SEQ ID NO: 1384087 - protein, 9 aa, Homo Sapiens
NFFEMTIKF

SEQ ID NO: 1384088 - protein, 9 aa, Homo Sapiens
NPSLVCVTT

SEQ ID NO: 1384089 - protein, 9 aa, Homo Sapiens
NDSQVETTF

SEQ ID NO: 1384090 - protein, 9 aa, Homo Sapiens
ISCSSLKNH

SEQ ID NO: 1384091 - protein, 9 aa, Homo Sapiens
LGVPELLVG

SEQ ID NO: 1384092 - protein, 9 aa, Homo Sapiens
HLQARLALP

SEQ ID NO: 1384093 - protein, 9 aa, Homo Sapiens
KNRVLEVKK

SEQ ID NO: 1384094 - protein, 9 aa, Homo Sapiens
DDRVGAGQG

SEQ ID NO: 1384095 - protein, 9 aa, Homo Sapiens
GVPPQQTRK

SEQ ID NO: 1384096 - protein, 9 aa, Homo Sapiens
VPMSLACSI

SEQ ID NO: 1384097 - protein, 9 aa, Homo Sapiens
STPVRKPHP

SEQ ID NO: 1384098 - protein, 9 aa, Homo Sapiens
CSMKMVLVL

SEQ ID NO: 1384099 - protein, 9 aa, Homo Sapiens
QAVDGWVEE

SEQ ID NO: 1384100 - protein, 9 aa, Homo Sapiens
YPEAVCVVY

SEQ ID NO: 1384101 - protein, 9 aa, Homo Sapiens
KKNRVLEVK

SEQ ID NO: 1384102 - protein, 9 aa, Homo Sapiens
ASVVITRGM

SEQ ID NO: 1384103 - protein, 9 aa, Homo Sapiens
AITDHVSDS

SEQ ID NO: 1384104 - protein, 9 aa, Homo Sapiens
EFLGSPKRQ

SEQ ID NO: 1384105 - protein, 9 aa, Homo Sapiens
HLWTRQRIF

SEQ ID NO: 1384106 - protein, 9 aa, Homo Sapiens
LQNLYLLIL

SEQ ID NO: 1384107 - protein, 9 aa, Homo Sapiens
HEFFMPELV

SEQ ID NO: 1384108 - protein, 9 aa, Homo Sapiens
LGAHAWLCH

SEQ ID NO: 1384109 - protein, 9 aa, Homo Sapiens
ILKGLEENL

SEQ ID NO: 1384110 - protein, 9 aa, Homo Sapiens
GKFAPFFVP

SEQ ID NO: 1384111 - protein, 9 aa, Homo Sapiens
AASRLPRMP

SEQ ID NO: 1384112 - protein, 9 aa, Homo Sapiens
PEVGGPGQS

SEQ ID NO: 1384113 - protein, 9 aa, Homo Sapiens
PEEEPILWL

SEQ ID NO: 1384114 - protein, 9 aa, Homo Sapiens
TGKIILVFT

SEQ ID NO: 1384115 - protein, 9 aa, Homo Sapiens
IVLSYIHIF

SEQ ID NO: 1384116 - protein, 9 aa, Homo Sapiens
HGPGPCIGE

SEQ ID NO: 1384117 - protein, 9 aa, Homo Sapiens
KEFLGSPKR

SEQ ID NO: 1384118 - protein, 9 aa, Homo Sapiens
CFYLHISQA

SEQ ID NO: 1384119 - protein, 9 aa, Homo Sapiens
VRPRSLRPE

SEQ ID NO: 1384120 - protein, 9 aa, Homo Sapiens
ACDITAWGG

SEQ ID NO: 1384121 - protein, 9 aa, Homo Sapiens
IAYNGIPSL

SEQ ID NO: 1384122 - protein, 9 aa, Homo Sapiens
EDDRVGAGQ

SEQ ID NO: 1384123 - protein, 9 aa, Homo Sapiens
ATPDQDCDK

SEQ ID NO: 1384124 - protein, 9 aa, Homo Sapiens
VGLSTWSAL

SEQ ID NO: 1384125 - protein, 9 aa, Homo Sapiens
QQIPEKKPE

SEQ ID NO: 1384126 - protein, 9 aa, Homo Sapiens
RKAFRRFSS

SEQ ID NO: 1384127 - protein, 9 aa, Homo Sapiens
GVLPCTLLP

SEQ ID NO: 1384128 - protein, 9 aa, Homo Sapiens
ARHGRFRRD

SEQ ID NO: 1384129 - protein, 9 aa, Homo Sapiens
VCNSSFSST

SEQ ID NO: 1384130 - protein, 9 aa, Homo Sapiens
KYPSIQACQ

SEQ ID NO: 1384131 - protein, 9 aa, Homo Sapiens
GWMYDTVQR

SEQ ID NO: 1384132 - protein, 9 aa, Homo Sapiens
VIFAIGPVG

SEQ ID NO: 1384133 - protein, 9 aa, Homo Sapiens
NSAMSQPAS

SEQ ID NO: 1384134 - protein, 9 aa, Homo Sapiens
RRFSSPRIS

SEQ ID NO: 1384135 - protein, 9 aa, Homo Sapiens
QMSGTSGKG

SEQ ID NO: 1384136 - protein, 9 aa, Homo Sapiens
GIAHLPLPS

SEQ ID NO: 1384137 - protein, 9 aa, Homo Sapiens
APCFLRSGM

SEQ ID NO: 1384138 - protein, 9 aa, Homo Sapiens
AQLRRQVRE

SEQ ID NO: 1384139 - protein, 9 aa, Homo Sapiens
CVSSTTTGP

SEQ ID NO: 1384140 - protein, 9 aa, Homo Sapiens
VALPPVTSQ

SEQ ID NO: 1384141 - protein, 9 aa, Homo Sapiens
SYAGSARVG

SEQ ID NO: 1384142 - protein, 9 aa, Homo Sapiens
QPAAPGLQW

SEQ ID NO: 1384143 - protein, 9 aa, Homo Sapiens
HLWTLDLVL

SEQ ID NO: 1384144 - protein, 9 aa, Homo Sapiens
GMLGSWYTV

SEQ ID NO: 1384145 - protein, 9 aa, Homo Sapiens
EMEPSRSSW

SEQ ID NO: 1384146 - protein, 9 aa, Homo Sapiens
FGTYICVAS

SEQ ID NO: 1384147 - protein, 9 aa, Homo Sapiens
QVDPEMAVK

SEQ ID NO: 1384148 - protein, 9 aa, Homo Sapiens
ASTPSTPVD

SEQ ID NO: 1384149 - protein, 9 aa, Homo Sapiens
AAASLGGLR

SEQ ID NO: 1384150 - protein, 9 aa, Homo Sapiens
DMIKMLVNG

SEQ ID NO: 1384151 - protein, 9 aa, Homo Sapiens
KCFKKRPQR

SEQ ID NO: 1384152 - protein, 9 aa, Homo Sapiens
PKKKATKLE

SEQ ID NO: 1384153 - protein, 9 aa, Homo Sapiens
TGRSGSRIP

SEQ ID NO: 1384154 - protein, 9 aa, Homo Sapiens
QRRSAHKEE

SEQ ID NO: 1384155 - protein, 9 aa, Homo Sapiens
PKIFRKMSS

SEQ ID NO: 1384156 - protein, 9 aa, Homo Sapiens
EPVLEGWMP

SEQ ID NO: 1384157 - protein, 9 aa, Homo Sapiens
RTLLPLLES

SEQ ID NO: 1384158 - protein, 9 aa, Homo Sapiens
HSPCINPLK

SEQ ID NO: 1384159 - protein, 9 aa, Homo Sapiens
TSATREPSS

SEQ ID NO: 1384160 - protein, 9 aa, Homo Sapiens
QTPVLFGYT

SEQ ID NO: 1384161 - protein, 9 aa, Homo Sapiens
RHKNKDMLV

SEQ ID NO: 1384162 - protein, 9 aa, Homo Sapiens
AAAEAALSQ

SEQ ID NO: 1384163 - protein, 9 aa, Homo Sapiens
HKNKDMLVN

SEQ ID NO: 1384164 - protein, 9 aa, Homo Sapiens
DDDEKRGSR

SEQ ID NO: 1384165 - protein, 9 aa, Homo Sapiens
QGKHKIAKF

SEQ ID NO: 1384166 - protein, 9 aa, Homo Sapiens
GRGRFMFQK

SEQ ID NO: 1384167 - protein, 9 aa, Homo Sapiens
RGRSQDCDQ

SEQ ID NO: 1384168 - protein, 9 aa, Homo Sapiens
PGMPASKKC

SEQ ID NO: 1384169 - protein, 9 aa, Homo Sapiens
ECHLVILSP

SEQ ID NO: 1384170 - protein, 9 aa, Homo Sapiens
SHAPPVAEE

SEQ ID NO: 1384171 - protein, 9 aa, Homo Sapiens
RADGLLCSS

SEQ ID NO: 1384172 - protein, 9 aa, Homo Sapiens
ISMMYITSK

SEQ ID NO: 1384173 - protein, 9 aa, Homo Sapiens
WRFANSSDR

SEQ ID NO: 1384174 - protein, 9 aa, Homo Sapiens
TPSHHPAPE

SEQ ID NO: 1384175 - protein, 9 aa, Homo Sapiens
FEKNRSLIL

SEQ ID NO: 1384176 - protein, 9 aa, Homo Sapiens
KGPKGGLQE

SEQ ID NO: 1384177 - protein, 9 aa, Homo Sapiens
EKVVLVTGQ

SEQ ID NO: 1384178 - protein, 9 aa, Homo Sapiens
AMLRYLETH

SEQ ID NO: 1384179 - protein, 9 aa, Homo Sapiens
VPLTMGWPR

SEQ ID NO: 1384180 - protein, 9 aa, Homo Sapiens
DDYDEEDGD

SEQ ID NO: 1384181 - protein, 9 aa, Homo Sapiens
FTWATKGRP

SEQ ID NO: 1384182 - protein, 9 aa, Homo Sapiens
ECLTAEILE

SEQ ID NO: 1384183 - protein, 9 aa, Homo Sapiens
YSMNPQPTP

SEQ ID NO: 1384184 - protein, 9 aa, Homo Sapiens
AANIQDKHL

SEQ ID NO: 1384185 - protein, 9 aa, Homo Sapiens
PAPESLEAS

SEQ ID NO: 1384186 - protein, 9 aa, Homo Sapiens
KGLEENLLG

SEQ ID NO: 1384187 - protein, 9 aa, Homo Sapiens
LCQVQSQAH

SEQ ID NO: 1384188 - protein, 9 aa, Homo Sapiens
IAVPTSDLG

SEQ ID NO: 1384189 - protein, 9 aa, Homo Sapiens
RDTLQLGMR

SEQ ID NO: 1384190 - protein, 9 aa, Homo Sapiens
VVASSSGGR

SEQ ID NO: 1384191 - protein, 9 aa, Homo Sapiens
QKNSSRADG

SEQ ID NO: 1384192 - protein, 9 aa, Homo Sapiens
LDISSLNRM

SEQ ID NO: 1384193 - protein, 9 aa, Homo Sapiens
PLLLVYIMS

SEQ ID NO: 1384194 - protein, 9 aa, Homo Sapiens
LSQNDAYND

SEQ ID NO: 1384195 - protein, 9 aa, Homo Sapiens
RVIDINDHY

SEQ ID NO: 1384196 - protein, 9 aa, Homo Sapiens
ANIQDKHLV

SEQ ID NO: 1384197 - protein, 9 aa, Homo Sapiens
KFYFDRNPH

SEQ ID NO: 1384198 - protein, 9 aa, Homo Sapiens
SPGHSLETG

SEQ ID NO: 1384199 - protein, 9 aa, Homo Sapiens
PKGGLQENE

SEQ ID NO: 1384200 - protein, 9 aa, Homo Sapiens
SCRRDDSSE

SEQ ID NO: 1384201 - protein, 9 aa, Homo Sapiens
SFEGQYKHM

SEQ ID NO: 1384202 - protein, 9 aa, Homo Sapiens
LLEGAGSRV

SEQ ID NO: 1384203 - protein, 9 aa, Homo Sapiens
IRKEEDGDA

SEQ ID NO: 1384204 - protein, 9 aa, Homo Sapiens
KVKGVQSAT

SEQ ID NO: 1384205 - protein, 9 aa, Homo Sapiens
KALAAGDYD

SEQ ID NO: 1384206 - protein, 9 aa, Homo Sapiens
DSTSKGDEK

SEQ ID NO: 1384207 - protein, 9 aa, Homo Sapiens
RRRRYRSCA

SEQ ID NO: 1384208 - protein, 9 aa, Homo Sapiens
LYLLILRFC

SEQ ID NO: 1384209 - protein, 9 aa, Homo Sapiens
TTLEKHYLS

SEQ ID NO: 1384210 - protein, 9 aa, Homo Sapiens
ERVGNMARP

SEQ ID NO: 1384211 - protein, 9 aa, Homo Sapiens
DDDVFEDNT

SEQ ID NO: 1384212 - protein, 9 aa, Homo Sapiens
LPATLLVTA

SEQ ID NO: 1384213 - protein, 9 aa, Homo Sapiens
RLPSLRTIS

SEQ ID NO: 1384214 - protein, 9 aa, Homo Sapiens
HSLGPSLAT

SEQ ID NO: 1384215 - protein, 9 aa, Homo Sapiens
EMVKNVLEN

SEQ ID NO: 1384216 - protein, 9 aa, Homo Sapiens
ATAILTGVY

SEQ ID NO: 1384217 - protein, 9 aa, Homo Sapiens
QQQQSQQQP

SEQ ID NO: 1384218 - protein, 9 aa, Homo Sapiens
VLAVVQKLR

SEQ ID NO: 1384219 - protein, 9 aa, Homo Sapiens
SPRVTRILP

SEQ ID NO: 1384220 - protein, 9 aa, Homo Sapiens
EVFDRKKRW

SEQ ID NO: 1384221 - protein, 9 aa, Homo Sapiens
TCPRAYQST

SEQ ID NO: 1384222 - protein, 9 aa, Homo Sapiens
HANLISALS

SEQ ID NO: 1384223 - protein, 9 aa, Homo Sapiens
VCVGGLSVC

SEQ ID NO: 1384224 - protein, 9 aa, Homo Sapiens
THLATGAMK

SEQ ID NO: 1384225 - protein, 9 aa, Homo Sapiens
PVEGEAKRW

SEQ ID NO: 1384226 - protein, 9 aa, Homo Sapiens
PQNAIRQHS

SEQ ID NO: 1384227 - protein, 9 aa, Homo Sapiens
LDMLHHFHT

SEQ ID NO: 1384228 - protein, 9 aa, Homo Sapiens
VYAMKILHK

SEQ ID NO: 1384229 - protein, 9 aa, Homo Sapiens
LGLVVSLWG

SEQ ID NO: 1384230 - protein, 9 aa, Homo Sapiens
TIGCWEKLF

SEQ ID NO: 1384231 - protein, 9 aa, Homo Sapiens
MYHCDMYVK

SEQ ID NO: 1384232 - protein, 9 aa, Homo Sapiens
TSAAGAQPA

SEQ ID NO: 1384233 - protein, 9 aa, Homo Sapiens
CRWLKMCPL

SEQ ID NO: 1384234 - protein, 9 aa, Homo Sapiens
DMLSGKINT

SEQ ID NO: 1384235 - protein, 9 aa, Homo Sapiens
ESSYRSSQC

SEQ ID NO: 1384236 - protein, 9 aa, Homo Sapiens
QRLCHGGLS

SEQ ID NO: 1384237 - protein, 9 aa, Homo Sapiens
EKKFLKILE

SEQ ID NO: 1384238 - protein, 9 aa, Homo Sapiens
SSTHLPPSS

SEQ ID NO: 1384239 - protein, 9 aa, Homo Sapiens
EENEKVVLV

SEQ ID NO: 1384240 - protein, 9 aa, Homo Sapiens
LLQRNLLRL

SEQ ID NO: 1384241 - protein, 9 aa, Homo Sapiens
TTKKCLGHL

SEQ ID NO: 1384242 - protein, 9 aa, Homo Sapiens
DTATKPGLQ

SEQ ID NO: 1384243 - protein, 9 aa, Homo Sapiens
DAANLEKIY

SEQ ID NO: 1384244 - protein, 9 aa, Homo Sapiens
METLVVVDK

SEQ ID NO: 1384245 - protein, 9 aa, Homo Sapiens
PNLHALSKL

SEQ ID NO: 1384246 - protein, 9 aa, Homo Sapiens
GFGHGLHRH

SEQ ID NO: 1384247 - protein, 9 aa, Homo Sapiens
FYSGDVILT

SEQ ID NO: 1384248 - protein, 9 aa, Homo Sapiens
TQTCTNPAP

SEQ ID NO: 1384249 - protein, 9 aa, Homo Sapiens
QWSPVVRPR

SEQ ID NO: 1384250 - protein, 9 aa, Homo Sapiens
LPSAPAAAP

SEQ ID NO: 1384251 - protein, 9 aa, Homo Sapiens
DPERVFTLA

SEQ ID NO: 1384252 - protein, 9 aa, Homo Sapiens
KKPEEEEEN

SEQ ID NO: 1384253 - protein, 9 aa, Homo Sapiens
SRLEVMHGG

SEQ ID NO: 1384254 - protein, 9 aa, Homo Sapiens
PPRPPWALM

SEQ ID NO: 1384255 - protein, 9 aa, Homo Sapiens
PPPSWTPAS

SEQ ID NO: 1384256 - protein, 9 aa, Homo Sapiens
ALKKKPLHQ

SEQ ID NO: 1384257 - protein, 9 aa, Homo Sapiens
TIWVYVYVD

SEQ ID NO: 1384258 - protein, 9 aa, Homo Sapiens
AWLCHLVPG

SEQ ID NO: 1384259 - protein, 9 aa, Homo Sapiens
LKEHLLSSN

SEQ ID NO: 1384260 - protein, 9 aa, Homo Sapiens
ISSSVIEQL

SEQ ID NO: 1384261 - protein, 9 aa, Homo Sapiens
SAYADDVEN

SEQ ID NO: 1384262 - protein, 9 aa, Homo Sapiens
KLHELVLTF

SEQ ID NO: 1384263 - protein, 9 aa, Homo Sapiens
SNRRFSSCR

SEQ ID NO: 1384264 - protein, 9 aa, Homo Sapiens
AGVSPLCHM

SEQ ID NO: 1384265 - protein, 9 aa, Homo Sapiens
LTPIEAYSS

SEQ ID NO: 1384266 - protein, 9 aa, Homo Sapiens
VLTVLDEEV

SEQ ID NO: 1384267 - protein, 9 aa, Homo Sapiens
LLLSAIVSI

SEQ ID NO: 1384268 - protein, 9 aa, Homo Sapiens
ASALTLGAT

SEQ ID NO: 1384269 - protein, 9 aa, Homo Sapiens
PCRRSSSAW

SEQ ID NO: 1384270 - protein, 9 aa, Homo Sapiens
IRRSKNRIA

SEQ ID NO: 1384271 - protein, 9 aa, Homo Sapiens
WCSAEPPYC

SEQ ID NO: 1384272 - protein, 9 aa, Homo Sapiens
HCSPARERV

SEQ ID NO: 1384273 - protein, 9 aa, Homo Sapiens
MQGARGLPG

SEQ ID NO: 1384274 - protein, 9 aa, Homo Sapiens
ICSMKMVLV

SEQ ID NO: 1384275 - protein, 9 aa, Homo Sapiens
SKGDESKIS

SEQ ID NO: 1384276 - protein, 9 aa, Homo Sapiens
TNKPPGAGE

SEQ ID NO: 1384277 - protein, 9 aa, Homo Sapiens
GRPGLQGPP

SEQ ID NO: 1384278 - protein, 9 aa, Homo Sapiens
ALEGVQTPV

SEQ ID NO: 1384279 - protein, 9 aa, Homo Sapiens
TDYMLSEEI

SEQ ID NO: 1384280 - protein, 9 aa, Homo Sapiens
QIKTKPTDT

SEQ ID NO: 1384281 - protein, 9 aa, Homo Sapiens
LLSSLSQND

SEQ ID NO: 1384282 - protein, 9 aa, Homo Sapiens
PPAPPTVSQ

SEQ ID NO: 1384283 - protein, 9 aa, Homo Sapiens
FGSVGEWLQ

SEQ ID NO: 1384284 - protein, 9 aa, Homo Sapiens
DYDQEPDGD

SEQ ID NO: 1384285 - protein, 9 aa, Homo Sapiens
IPDPERVFT

SEQ ID NO: 1384286 - protein, 9 aa, Homo Sapiens
MKSCKVRLL

SEQ ID NO: 1384287 - protein, 9 aa, Homo Sapiens
PFRIQHMDL

SEQ ID NO: 1384288 - protein, 9 aa, Homo Sapiens
SAQEREYIH

SEQ ID NO: 1384289 - protein, 9 aa, Homo Sapiens
DLAGSILSC

SEQ ID NO: 1384290 - protein, 9 aa, Homo Sapiens
PSSLLSPCN

SEQ ID NO: 1384291 - protein, 9 aa, Homo Sapiens
NQSLLSILK

SEQ ID NO: 1384292 - protein, 9 aa, Homo Sapiens
LWMSESPEQ

SEQ ID NO: 1384293 - protein, 9 aa, Homo Sapiens
SGCAFVVSQ

SEQ ID NO: 1384294 - protein, 9 aa, Homo Sapiens
VPKDNKSKI

SEQ ID NO: 1384295 - protein, 9 aa, Homo Sapiens
SSAPHPPNY

SEQ ID NO: 1384296 - protein, 9 aa, Homo Sapiens
TYWTNLQAA

SEQ ID NO: 1384297 - protein, 9 aa, Homo Sapiens
QATRKHIII

SEQ ID NO: 1384298 - protein, 9 aa, Homo Sapiens
SPCINPLKS

SEQ ID NO: 1384299 - protein, 9 aa, Homo Sapiens
VLKGKRSHL

SEQ ID NO: 1384300 - protein, 9 aa, Homo Sapiens
AYSKHTLSA

SEQ ID NO: 1384301 - protein, 9 aa, Homo Sapiens
HFSPFRIQH

SEQ ID NO: 1384302 - protein, 9 aa, Homo Sapiens
DRGCNWTPE

SEQ ID NO: 1384303 - protein, 9 aa, Homo Sapiens
TKKKRNRRH

SEQ ID NO: 1384304 - protein, 9 aa, Homo Sapiens
QYIAVRTVR

SEQ ID NO: 1384305 - protein, 9 aa, Homo Sapiens
AVVKKCHEK

SEQ ID NO: 1384306 - protein, 9 aa, Homo Sapiens
EHVMKLRRA

SEQ ID NO: 1384307 - protein, 9 aa, Homo Sapiens
FVPMSLACS

SEQ ID NO: 1384308 - protein, 9 aa, Homo Sapiens
QEVAQLRRQ

SEQ ID NO: 1384309 - protein, 9 aa, Homo Sapiens
QPGVLCCYC

SEQ ID NO: 1384310 - protein, 9 aa, Homo Sapiens
LETHCTVAV

SEQ ID NO: 1384311 - protein, 9 aa, Homo Sapiens
NSSFSSTSS

SEQ ID NO: 1384312 - protein, 9 aa, Homo Sapiens
TWDPGMDTA

SEQ ID NO: 1384313 - protein, 9 aa, Homo Sapiens
TRQRIFITT

SEQ ID NO: 1384314 - protein, 9 aa, Homo Sapiens
VAHLACPEA

SEQ ID NO: 1384315 - protein, 9 aa, Homo Sapiens
HLAFSPGHS

SEQ ID NO: 1384316 - protein, 9 aa, Homo Sapiens
AFRASLSTL

SEQ ID NO: 1384317 - protein, 9 aa, Homo Sapiens
SVMALAGFG

SEQ ID NO: 1384318 - protein, 9 aa, Homo Sapiens
PALVRFLRN

SEQ ID NO: 1384319 - protein, 9 aa, Homo Sapiens
SFYHTGGSH

SEQ ID NO: 1384320 - protein, 9 aa, Homo Sapiens
APPEWKCSP

SEQ ID NO: 1384321 - protein, 9 aa, Homo Sapiens
AISKVKLRM

SEQ ID NO: 1384322 - protein, 9 aa, Homo Sapiens
PQTETRAPT

SEQ ID NO: 1384323 - protein, 9 aa, Homo Sapiens
TKKASAIAI

SEQ ID NO: 1384324 - protein, 9 aa, Homo Sapiens
ALDDYSVSN

SEQ ID NO: 1384325 - protein, 9 aa, Homo Sapiens
KSTTEVIRN

SEQ ID NO: 1384326 - protein, 9 aa, Homo Sapiens
FRVAIRVLL

SEQ ID NO: 1384327 - protein, 9 aa, Homo Sapiens
LCLKKGRYL

SEQ ID NO: 1384328 - protein, 9 aa, Homo Sapiens
HGAPAPPEW

SEQ ID NO: 1384329 - protein, 9 aa, Homo Sapiens
TMTRPSALD

SEQ ID NO: 1384330 - protein, 9 aa, Homo Sapiens
EDPCFIFNN

SEQ ID NO: 1384331 - protein, 9 aa, Homo Sapiens
GTSGKGFVA

SEQ ID NO: 1384332 - protein, 9 aa, Homo Sapiens
AERVGNMAR

SEQ ID NO: 1384333 - protein, 9 aa, Homo Sapiens
QTETRAPTP

SEQ ID NO: 1384334 - protein, 9 aa, Homo Sapiens
KILDSSHTQ

SEQ ID NO: 1384335 - protein, 9 aa, Homo Sapiens
PDVIAKKQN

SEQ ID NO: 1384336 - protein, 9 aa, Homo Sapiens
LETQKHWAS

SEQ ID NO: 1384337 - protein, 9 aa, Homo Sapiens
CPISRLSCE

SEQ ID NO: 1384338 - protein, 9 aa, Homo Sapiens
HHVVPAQVH

SEQ ID NO: 1384339 - protein, 9 aa, Homo Sapiens
HKGGVPPQQ

SEQ ID NO: 1384340 - protein, 9 aa, Homo Sapiens
GSRVLDCAN

SEQ ID NO: 1384341 - protein, 9 aa, Homo Sapiens
SSSGGRTAA

SEQ ID NO: 1384342 - protein, 9 aa, Homo Sapiens
NPKGPKGGL

SEQ ID NO: 1384343 - protein, 9 aa, Homo Sapiens
AQPTLPLPL

SEQ ID NO: 1384344 - protein, 9 aa, Homo Sapiens
SSSQCTQGR

SEQ ID NO: 1384345 - protein, 9 aa, Homo Sapiens
SLHQATRKH

SEQ ID NO: 1384346 - protein, 9 aa, Homo Sapiens
QDNCQPTNV

SEQ ID NO: 1384347 - protein, 9 aa, Homo Sapiens
HGAGKLPHH

SEQ ID NO: 1384348 - protein, 9 aa, Homo Sapiens
QVHQLLLSR

SEQ ID NO: 1384349 - protein, 9 aa, Homo Sapiens
NRRFSSCRR

SEQ ID NO: 1384350 - protein, 9 aa, Homo Sapiens
NIGGIIGGF

SEQ ID NO: 1384351 - protein, 9 aa, Homo Sapiens
KQDSDSKHV

SEQ ID NO: 1384352 - protein, 9 aa, Homo Sapiens
AEVSPSARW

SEQ ID NO: 1384353 - protein, 9 aa, Homo Sapiens
SMKKTIGCW

SEQ ID NO: 1384354 - protein, 9 aa, Homo Sapiens
GKAIRSSPK

SEQ ID NO: 1384355 - protein, 9 aa, Homo Sapiens
WEKLFSMFF

SEQ ID NO: 1384356 - protein, 9 aa, Homo Sapiens
QQQLYRPLV

SEQ ID NO: 1384357 - protein, 9 aa, Homo Sapiens
AHWKLQTHP

SEQ ID NO: 1384358 - protein, 9 aa, Homo Sapiens
DMEIMSHYR

SEQ ID NO: 1384359 - protein, 9 aa, Homo Sapiens
MAANRTPTL

SEQ ID NO: 1384360 - protein, 9 aa, Homo Sapiens
HSTDKNGFK

SEQ ID NO: 1384361 - protein, 9 aa, Homo Sapiens
FNPKGPKGG

SEQ ID NO: 1384362 - protein, 9 aa, Homo Sapiens
EQSEIERIF

SEQ ID NO: 1384363 - protein, 9 aa, Homo Sapiens
SQQQPPQPQ

SEQ ID NO: 1384364 - protein, 9 aa, Homo Sapiens
SELCRLYMQ

SEQ ID NO: 1384365 - protein, 9 aa, Homo Sapiens
GEGTTVSYE

SEQ ID NO: 1384366 - protein, 9 aa, Homo Sapiens
KSPQPPELV

SEQ ID NO: 1384367 - protein, 9 aa, Homo Sapiens
FEKLSAGQN

SEQ ID NO: 1384368 - protein, 9 aa, Homo Sapiens
SARVGTWLT

SEQ ID NO: 1384369 - protein, 9 aa, Homo Sapiens
WLTAWTCHW

SEQ ID NO: 1384370 - protein, 9 aa, Homo Sapiens
HPAPESLEA

SEQ ID NO: 1384371 - protein, 9 aa, Homo Sapiens
PSLARLLAG

SEQ ID NO: 1384372 - protein, 9 aa, Homo Sapiens
CVQGVAAPP

SEQ ID NO: 1384373 - protein, 9 aa, Homo Sapiens
EENQMAGRP

SEQ ID NO: 1384374 - protein, 9 aa, Homo Sapiens
DVTPTTSSL

SEQ ID NO: 1384375 - protein, 9 aa, Homo Sapiens
HELPGGLRH

SEQ ID NO: 1384376 - protein, 9 aa, Homo Sapiens
RKPLEAMLR

SEQ ID NO: 1384377 - protein, 9 aa, Homo Sapiens
LLFVFNFFW

SEQ ID NO: 1384378 - protein, 9 aa, Homo Sapiens
DLPRRRLCQ

SEQ ID NO: 1384379 - protein, 9 aa, Homo Sapiens
PDDYDEEDG

SEQ ID NO: 1384380 - protein, 9 aa, Homo Sapiens
EPNLVLDEI

SEQ ID NO: 1384381 - protein, 9 aa, Homo Sapiens
QEAFAQGMR

SEQ ID NO: 1384382 - protein, 9 aa, Homo Sapiens
QSLGRPGRE

SEQ ID NO: 1384383 - protein, 9 aa, Homo Sapiens
IISETPLPV

SEQ ID NO: 1384384 - protein, 9 aa, Homo Sapiens
SQVIIAMYM

SEQ ID NO: 1384385 - protein, 9 aa, Homo Sapiens
SSCTLDQIC

SEQ ID NO: 1384386 - protein, 9 aa, Homo Sapiens
AAAASLGGL

SEQ ID NO: 1384387 - protein, 9 aa, Homo Sapiens
STQGMLMAG

SEQ ID NO: 1384388 - protein, 9 aa, Homo Sapiens
YVKLDRLGE

SEQ ID NO: 1384389 - protein, 9 aa, Homo Sapiens
NSVKDVVCK

SEQ ID NO: 1384390 - protein, 9 aa, Homo Sapiens
QQAKREEEC

SEQ ID NO: 1384391 - protein, 9 aa, Homo Sapiens
PYWNSKLTY

SEQ ID NO: 1384392 - protein, 9 aa, Homo Sapiens
HPRKVAGGH

SEQ ID NO: 1384393 - protein, 9 aa, Homo Sapiens
RDPQDGCND

SEQ ID NO: 1384394 - protein, 9 aa, Homo Sapiens
RGYRERGGG

SEQ ID NO: 1384395 - protein, 9 aa, Homo Sapiens
FSTRNNLGF

SEQ ID NO: 1384396 - protein, 9 aa, Homo Sapiens
KVGAAISMM

SEQ ID NO: 1384397 - protein, 9 aa, Homo Sapiens
LASQAISAR

SEQ ID NO: 1384398 - protein, 9 aa, Homo Sapiens
RVGKIPDKE

SEQ ID NO: 1384399 - protein, 9 aa, Homo Sapiens
KKEWLILKG

SEQ ID NO: 1384400 - protein, 9 aa, Homo Sapiens
STGSAPRAP

SEQ ID NO: 1384401 - protein, 9 aa, Homo Sapiens
QASPTKIET

SEQ ID NO: 1384402 - protein, 9 aa, Homo Sapiens
CLESGMSQT

SEQ ID NO: 1384403 - protein, 9 aa, Homo Sapiens
CCGSSWYIQ

SEQ ID NO: 1384404 - protein, 9 aa, Homo Sapiens
IHDIRRSKN

SEQ ID NO: 1384405 - protein, 9 aa, Homo Sapiens
ETTFCATLL

SEQ ID NO: 1384406 - protein, 9 aa, Homo Sapiens
HTNSSVSSS

SEQ ID NO: 1384407 - protein, 9 aa, Homo Sapiens
GPNEAPPPS

SEQ ID NO: 1384408 - protein, 9 aa, Homo Sapiens
LFKLLWDRI

SEQ ID NO: 1384409 - protein, 9 aa, Homo Sapiens
LVPQSPPMD

SEQ ID NO: 1384410 - protein, 9 aa, Homo Sapiens
LCVKKLYVL

SEQ ID NO: 1384411 - protein, 9 aa, Homo Sapiens
LCGRHMCSM

SEQ ID NO: 1384412 - protein, 9 aa, Homo Sapiens
QIPEKKPEE

SEQ ID NO: 1384413 - protein, 9 aa, Homo Sapiens
MKILHKADM

SEQ ID NO: 1384414 - protein, 9 aa, Homo Sapiens
IWLFKHHRA

SEQ ID NO: 1384415 - protein, 9 aa, Homo Sapiens
SHVQVGGIS

SEQ ID NO: 1384416 - protein, 9 aa, Homo Sapiens
VMALAGFGH

SEQ ID NO: 1384417 - protein, 9 aa, Homo Sapiens
YNDSVEHRD

SEQ ID NO: 1384418 - protein, 9 aa, Homo Sapiens
PTGWEEEDD

SEQ ID NO: 1384419 - protein, 9 aa, Homo Sapiens
VLDVDTINH

SEQ ID NO: 1384420 - protein, 9 aa, Homo Sapiens
APVQRTACD

SEQ ID NO: 1384421 - protein, 9 aa, Homo Sapiens
LTGEQTHWL

SEQ ID NO: 1384422 - protein, 9 aa, Homo Sapiens
AQVFIQKNL

SEQ ID NO: 1384423 - protein, 9 aa, Homo Sapiens
GLGSSCCGR

SEQ ID NO: 1384424 - protein, 9 aa, Homo Sapiens
SSTSFLSMW

SEQ ID NO: 1384425 - protein, 9 aa, Homo Sapiens
RPVEDPESK

SEQ ID NO: 1384426 - protein, 9 aa, Homo Sapiens
PPAALVSWK

SEQ ID NO: 1384427 - protein, 9 aa, Homo Sapiens
IQKNLCPAV

SEQ ID NO: 1384428 - protein, 9 aa, Homo Sapiens
LHRLWWPHG

SEQ ID NO: 1384429 - protein, 9 aa, Homo Sapiens
KSSSKDSLT

SEQ ID NO: 1384430 - protein, 9 aa, Homo Sapiens
IDLKKEWLI

SEQ ID NO: 1384431 - protein, 9 aa, Homo Sapiens
ADGSITRDD

SEQ ID NO: 1384432 - protein, 9 aa, Homo Sapiens
AAALPGQPP

SEQ ID NO: 1384433 - protein, 9 aa, Homo Sapiens
KWICSMKMV

SEQ ID NO: 1384434 - protein, 9 aa, Homo Sapiens
LWVAALEGH

SEQ ID NO: 1384435 - protein, 9 aa, Homo Sapiens
LLLKHLQPE

SEQ ID NO: 1384436 - protein, 9 aa, Homo Sapiens
VKLRMSFLL

SEQ ID NO: 1384437 - protein, 9 aa, Homo Sapiens
LPGPCASLL

SEQ ID NO: 1384438 - protein, 9 aa, Homo Sapiens
DYLGLETQK

SEQ ID NO: 1384439 - protein, 9 aa, Homo Sapiens
ARAPAPTCV

SEQ ID NO: 1384440 - protein, 9 aa, Homo Sapiens
WDWAPRQTH

SEQ ID NO: 1384441 - protein, 9 aa, Homo Sapiens
LKSSMEVYA

SEQ ID NO: 1384442 - protein, 9 aa, Homo Sapiens
AQKNECTGK

SEQ ID NO: 1384443 - protein, 9 aa, Homo Sapiens
LTLASAHVG

SEQ ID NO: 1384444 - protein, 9 aa, Homo Sapiens
LVNGKKGAL

SEQ ID NO: 1384445 - protein, 9 aa, Homo Sapiens
ETKEEYLVV

SEQ ID NO: 1384446 - protein, 9 aa, Homo Sapiens
PEEEEENQM

SEQ ID NO: 1384447 - protein, 9 aa, Homo Sapiens
HPTLQAIAC

SEQ ID NO: 1384448 - protein, 9 aa, Homo Sapiens
SRSFFTSAH

SEQ ID NO: 1384449 - protein, 9 aa, Homo Sapiens
WLHRLWWPH

SEQ ID NO: 1384450 - protein, 9 aa, Homo Sapiens
QAPSQVWTA

SEQ ID NO: 1384451 - protein, 9 aa, Homo Sapiens
QKSSTSPKW

SEQ ID NO: 1384452 - protein, 9 aa, Homo Sapiens
LKNILPKST

SEQ ID NO: 1384453 - protein, 9 aa, Homo Sapiens
CQKTVPPEP

SEQ ID NO: 1384454 - protein, 9 aa, Homo Sapiens
VCDGRLYAS

SEQ ID NO: 1384455 - protein, 9 aa, Homo Sapiens
DPKIGVAIQ

SEQ ID NO: 1384456 - protein, 9 aa, Homo Sapiens
TAHVHIRVL

SEQ ID NO: 1384457 - protein, 9 aa, Homo Sapiens
FFEMTIKFA

SEQ ID NO: 1384458 - protein, 9 aa, Homo Sapiens
GQVWASAIA

SEQ ID NO: 1384459 - protein, 9 aa, Homo Sapiens
QKEMKYEHQ

SEQ ID NO: 1384460 - protein, 9 aa, Homo Sapiens
CFHVRFDLL

SEQ ID NO: 1384461 - protein, 9 aa, Homo Sapiens
GSLPLRSSG

SEQ ID NO: 1384462 - protein, 9 aa, Homo Sapiens
CHLVPGDLP

SEQ ID NO: 1384463 - protein, 9 aa, Homo Sapiens
RKKEEDWKC

SEQ ID NO: 1384464 - protein, 9 aa, Homo Sapiens
KNSYWRETL

SEQ ID NO: 1384465 - protein, 9 aa, Homo Sapiens
LQKSANLWG

SEQ ID NO: 1384466 - protein, 9 aa, Homo Sapiens
SAHKEEEDD

SEQ ID NO: 1384467 - protein, 9 aa, Homo Sapiens
LCSSERAGD

SEQ ID NO: 1384468 - protein, 9 aa, Homo Sapiens
NTAWKTKKT

SEQ ID NO: 1384469 - protein, 9 aa, Homo Sapiens
STGGWPTSS

SEQ ID NO: 1384470 - protein, 9 aa, Homo Sapiens
TPPSTQFHS

SEQ ID NO: 1384471 - protein, 9 aa, Homo Sapiens
AVKLHPHDK

SEQ ID NO: 1384472 - protein, 9 aa, Homo Sapiens
CTSSSMSSC

SEQ ID NO: 1384473 - protein, 9 aa, Homo Sapiens
LMLEELRNL

SEQ ID NO: 1384474 - protein, 9 aa, Homo Sapiens
VGGVEAEAV

SEQ ID NO: 1384475 - protein, 9 aa, Homo Sapiens
GHGLHRHRG

SEQ ID NO: 1384476 - protein, 9 aa, Homo Sapiens
YSVIFAIGP

SEQ ID NO: 1384477 - protein, 9 aa, Homo Sapiens
IYIFPAVAF

SEQ ID NO: 1384478 - protein, 9 aa, Homo Sapiens
SEEAQKKLY

SEQ ID NO: 1384479 - protein, 9 aa, Homo Sapiens
GRNPTLFPR

SEQ ID NO: 1384480 - protein, 9 aa, Homo Sapiens
PGLDVVAQM

SEQ ID NO: 1384481 - protein, 9 aa, Homo Sapiens
LEAMLRYLE

SEQ ID NO: 1384482 - protein, 9 aa, Homo Sapiens
PLLSFKQPR

SEQ ID NO: 1384483 - protein, 9 aa, Homo Sapiens
AQELLLANI

SEQ ID NO: 1384484 - protein, 9 aa, Homo Sapiens
RIQQRQDNC

SEQ ID NO: 1384485 - protein, 9 aa, Homo Sapiens
PSPLTCRCT

SEQ ID NO: 1384486 - protein, 9 aa, Homo Sapiens
INVQDYEVM

SEQ ID NO: 1384487 - protein, 9 aa, Homo Sapiens
FTTGRLMTR

SEQ ID NO: 1384488 - protein, 9 aa, Homo Sapiens
SESSHLQAH

SEQ ID NO: 1384489 - protein, 9 aa, Homo Sapiens
VVLEARAPH

SEQ ID NO: 1384490 - protein, 9 aa, Homo Sapiens
EDPESKQTA

SEQ ID NO: 1384491 - protein, 9 aa, Homo Sapiens
HRARQLRKQ

SEQ ID NO: 1384492 - protein, 9 aa, Homo Sapiens
IELHSDVEY

SEQ ID NO: 1384493 - protein, 9 aa, Homo Sapiens
ASCLCPLAS

SEQ ID NO: 1384494 - protein, 9 aa, Homo Sapiens
HVLALEVTF

SEQ ID NO: 1384495 - protein, 9 aa, Homo Sapiens
TWTDIFKRF

SEQ ID NO: 1384496 - protein, 9 aa, Homo Sapiens
LAMGQTTQC

SEQ ID NO: 1384497 - protein, 9 aa, Homo Sapiens
QRLWDWAPR

SEQ ID NO: 1384498 - protein, 9 aa, Homo Sapiens
LTQPPTLGC

SEQ ID NO: 1384499 - protein, 9 aa, Homo Sapiens
PTPSPLTCR

SEQ ID NO: 1384500 - protein, 9 aa, Homo Sapiens
LTNTSATRE

SEQ ID NO: 1384501 - protein, 9 aa, Homo Sapiens
RRSGTLGLV

SEQ ID NO: 1384502 - protein, 9 aa, Homo Sapiens
RKHNSNANI

SEQ ID NO: 1384503 - protein, 9 aa, Homo Sapiens
VQIGGNPGL

SEQ ID NO: 1384504 - protein, 9 aa, Homo Sapiens
SWPTAAPPT

SEQ ID NO: 1384505 - protein, 9 aa, Homo Sapiens
VGNMARPLL

SEQ ID NO: 1384506 - protein, 9 aa, Homo Sapiens
EWLILKGLE

SEQ ID NO: 1384507 - protein, 9 aa, Homo Sapiens
YWNSKLTYL

SEQ ID NO: 1384508 - protein, 9 aa, Homo Sapiens
RKHSEVMLD

SEQ ID NO: 1384509 - protein, 9 aa, Homo Sapiens
ALPRRLGAG

SEQ ID NO: 1384510 - protein, 9 aa, Homo Sapiens
IREKPQEVC

SEQ ID NO: 1384511 - protein, 9 aa, Homo Sapiens
DRQSFNKFI

SEQ ID NO: 1384512 - protein, 9 aa, Homo Sapiens
ELHSRRMSV

SEQ ID NO: 1384513 - protein, 9 aa, Homo Sapiens
LSPCRWLKM

SEQ ID NO: 1384514 - protein, 9 aa, Homo Sapiens
ATGNRELLQ

SEQ ID NO: 1384515 - protein, 9 aa, Homo Sapiens
YLCCALWGW

SEQ ID NO: 1384516 - protein, 9 aa, Homo Sapiens
QVRCPACCM

SEQ ID NO: 1384517 - protein, 9 aa, Homo Sapiens
KRKKKKRPF

SEQ ID NO: 1384518 - protein, 9 aa, Homo Sapiens
QQVQLDPGA

SEQ ID NO: 1384519 - protein, 9 aa, Homo Sapiens
TPVRKPHPG

SEQ ID NO: 1384520 - protein, 9 aa, Homo Sapiens
DWKCVLRTD

SEQ ID NO: 1384521 - protein, 9 aa, Homo Sapiens
PLWKELSHL

SEQ ID NO: 1384522 - protein, 9 aa, Homo Sapiens
GVHGPGPCI

SEQ ID NO: 1384523 - protein, 9 aa, Homo Sapiens
NSHTGRSGS

SEQ ID NO: 1384524 - protein, 9 aa, Homo Sapiens
LVLTLTKMI

SEQ ID NO: 1384525 - protein, 9 aa, Homo Sapiens
WGNCRPIRF

SEQ ID NO: 1384526 - protein, 9 aa, Homo Sapiens
EQGKHKIAK

SEQ ID NO: 1384527 - protein, 9 aa, Homo Sapiens
MAFDCFVAI

SEQ ID NO: 1384528 - protein, 9 aa, Homo Sapiens
LTSQEILLL

SEQ ID NO: 1384529 - protein, 9 aa, Homo Sapiens
VFTFASTYI

SEQ ID NO: 1384530 - protein, 9 aa, Homo Sapiens
TWTFSPRVT

SEQ ID NO: 1384531 - protein, 9 aa, Homo Sapiens
GWGWGAWLA

SEQ ID NO: 1384532 - protein, 9 aa, Homo Sapiens
RPMGARAPA

SEQ ID NO: 1384533 - protein, 9 aa, Homo Sapiens
VETVNREPF

SEQ ID NO: 1384534 - protein, 9 aa, Homo Sapiens
NGQGFHDET

SEQ ID NO: 1384535 - protein, 9 aa, Homo Sapiens
ARLLAGSVG

SEQ ID NO: 1384536 - protein, 9 aa, Homo Sapiens
MLVMLPSCK

SEQ ID NO: 1384537 - protein, 9 aa, Homo Sapiens
AVSLTCHFH

SEQ ID NO: 1384538 - protein, 9 aa, Homo Sapiens
WEEEDDVEI

SEQ ID NO: 1384539 - protein, 9 aa, Homo Sapiens
CGCAERVGN

SEQ ID NO: 1384540 - protein, 9 aa, Homo Sapiens
PEDSPPRGR

SEQ ID NO: 1384541 - protein, 9 aa, Homo Sapiens
VACSYLSLK

SEQ ID NO: 1384542 - protein, 9 aa, Homo Sapiens
SPARAAALQ

SEQ ID NO: 1384543 - protein, 9 aa, Homo Sapiens
SNILILEKI

SEQ ID NO: 1384544 - protein, 9 aa, Homo Sapiens
GAAQLLGMC

SEQ ID NO: 1384545 - protein, 9 aa, Homo Sapiens
HDNLPELYP

SEQ ID NO: 1384546 - protein, 9 aa, Homo Sapiens
PEAVCVVYT

SEQ ID NO: 1384547 - protein, 9 aa, Homo Sapiens
SPQPPELVS

SEQ ID NO: 1384548 - protein, 9 aa, Homo Sapiens
LSQPPPQAP

SEQ ID NO: 1384549 - protein, 9 aa, Homo Sapiens
QQGPPPQGK

SEQ ID NO: 1384550 - protein, 9 aa, Homo Sapiens
LCRQWLHPE

SEQ ID NO: 1384551 - protein, 9 aa, Homo Sapiens
VPPSTQVEQ

SEQ ID NO: 1384552 - protein, 9 aa, Homo Sapiens
GANSDSSSP

SEQ ID NO: 1384553 - protein, 9 aa, Homo Sapiens
FDSALHHRL

SEQ ID NO: 1384554 - protein, 9 aa, Homo Sapiens
AKACPISRL

SEQ ID NO: 1384555 - protein, 9 aa, Homo Sapiens
STWDLPRRR

SEQ ID NO: 1384556 - protein, 9 aa, Homo Sapiens
QQSQQQPPQ

SEQ ID NO: 1384557 - protein, 9 aa, Homo Sapiens
FARGLKMKC

SEQ ID NO: 1384558 - protein, 9 aa, Homo Sapiens
PERAGASGA

SEQ ID NO: 1384559 - protein, 9 aa, Homo Sapiens
KGLLGLPGP

SEQ ID NO: 1384560 - protein, 9 aa, Homo Sapiens
NRSLPHAPA

SEQ ID NO: 1384561 - protein, 9 aa, Homo Sapiens
PRSTATSSS

SEQ ID NO: 1384562 - protein, 9 aa, Homo Sapiens
PVVKVTATG

SEQ ID NO: 1384563 - protein, 9 aa, Homo Sapiens
GGAERSHGR

SEQ ID NO: 1384564 - protein, 9 aa, Homo Sapiens
DGEEGGCAS

SEQ ID NO: 1384565 - protein, 9 aa, Homo Sapiens
HMNSVKDVV

SEQ ID NO: 1384566 - protein, 9 aa, Homo Sapiens
WQKRTQTCT

SEQ ID NO: 1384567 - protein, 9 aa, Homo Sapiens
RVIVERIGL

SEQ ID NO: 1384568 - protein, 9 aa, Homo Sapiens
LEGAGSRVC

SEQ ID NO: 1384569 - protein, 9 aa, Homo Sapiens
ALLDKKNRV

SEQ ID NO: 1384570 - protein, 9 aa, Homo Sapiens
PKCNRAICR

SEQ ID NO: 1384571 - protein, 9 aa, Homo Sapiens
VVGRFPREH

SEQ ID NO: 1384572 - protein, 9 aa, Homo Sapiens
RTGRQHPPP

SEQ ID NO: 1384573 - protein, 9 aa, Homo Sapiens
CIPNTFKYP

SEQ ID NO: 1384574 - protein, 9 aa, Homo Sapiens
APRAPPIMA

SEQ ID NO: 1384575 - protein, 9 aa, Homo Sapiens
CQCDKKRGA

SEQ ID NO: 1384576 - protein, 9 aa, Homo Sapiens
VIALKSSME

SEQ ID NO: 1384577 - protein, 9 aa, Homo Sapiens
PISRLSCER

SEQ ID NO: 1384578 - protein, 9 aa, Homo Sapiens
LKSVDFEAV

SEQ ID NO: 1384579 - protein, 9 aa, Homo Sapiens
RGALTTRPS

SEQ ID NO: 1384580 - protein, 9 aa, Homo Sapiens
STPSTPVDR

SEQ ID NO: 1384581 - protein, 9 aa, Homo Sapiens
WGWSLWLSW

SEQ ID NO: 1384582 - protein, 9 aa, Homo Sapiens
VLVFMKMEF

SEQ ID NO: 1384583 - protein, 9 aa, Homo Sapiens
GVAIQEELG

SEQ ID NO: 1384584 - protein, 9 aa, Homo Sapiens
NKPPGAGEE

SEQ ID NO: 1384585 - protein, 9 aa, Homo Sapiens
QLQGFLILP

SEQ ID NO: 1384586 - protein, 9 aa, Homo Sapiens
PEARAPTKQ

SEQ ID NO: 1384587 - protein, 9 aa, Homo Sapiens
AGCSTTAAT

SEQ ID NO: 1384588 - protein, 9 aa, Homo Sapiens
GLSQEATRR

SEQ ID NO: 1384589 - protein, 9 aa, Homo Sapiens
GWMGPKCNR

SEQ ID NO: 1384590 - protein, 9 aa, Homo Sapiens
KEKKSTKPQ

SEQ ID NO: 1384591 - protein, 9 aa, Homo Sapiens
IDDVFNFET

SEQ ID NO: 1384592 - protein, 9 aa, Homo Sapiens
DSGADTGLV

SEQ ID NO: 1384593 - protein, 9 aa, Homo Sapiens
SITSIREKP

SEQ ID NO: 1384594 - protein, 9 aa, Homo Sapiens
GEKGDRSKR

SEQ ID NO: 1384595 - protein, 9 aa, Homo Sapiens
PQLAWVSFS

SEQ ID NO: 1384596 - protein, 9 aa, Homo Sapiens
SFEDFLLVF

SEQ ID NO: 1384597 - protein, 9 aa, Homo Sapiens
VFEDNTSAK

SEQ ID NO: 1384598 - protein, 9 aa, Homo Sapiens
FGQASLIDG

SEQ ID NO: 1384599 - protein, 9 aa, Homo Sapiens
VALRPRPGQ

SEQ ID NO: 1384600 - protein, 9 aa, Homo Sapiens
NTSAKLKSR

SEQ ID NO: 1384601 - protein, 9 aa, Homo Sapiens
GKWGSSKSG

SEQ ID NO: 1384602 - protein, 9 aa, Homo Sapiens
MLMAVDWTL

SEQ ID NO: 1384603 - protein, 9 aa, Homo Sapiens
LTRQDVQSL

SEQ ID NO: 1384604 - protein, 9 aa, Homo Sapiens
LKSCIKWLR

SEQ ID NO: 1384605 - protein, 9 aa, Homo Sapiens
KRIFIPMTS

SEQ ID NO: 1384606 - protein, 9 aa, Homo Sapiens
TRAPTPRSP

SEQ ID NO: 1384607 - protein, 9 aa, Homo Sapiens
KNPIYSCNV

SEQ ID NO: 1384608 - protein, 9 aa, Homo Sapiens
AKCITAHEA

SEQ ID NO: 1384609 - protein, 9 aa, Homo Sapiens
SKTRGKNFR

SEQ ID NO: 1384610 - protein, 9 aa, Homo Sapiens
QKVILWDLL

SEQ ID NO: 1384611 - protein, 9 aa, Homo Sapiens
WRRSGTLGL

SEQ ID NO: 1384612 - protein, 9 aa, Homo Sapiens
GKYKEVVAQ

SEQ ID NO: 1384613 - protein, 9 aa, Homo Sapiens
HKTRPLVVK

SEQ ID NO: 1384614 - protein, 9 aa, Homo Sapiens
RFDLLGQPM

SEQ ID NO: 1384615 - protein, 9 aa, Homo Sapiens
HAWLCHLVP

SEQ ID NO: 1384616 - protein, 9 aa, Homo Sapiens
VHSPCINPL

SEQ ID NO: 1384617 - protein, 9 aa, Homo Sapiens
LKMKCVGHE

SEQ ID NO: 1384618 - protein, 9 aa, Homo Sapiens
YSTRYIYLL

SEQ ID NO: 1384619 - protein, 9 aa, Homo Sapiens
IFVLLLSAI

SEQ ID NO: 1384620 - protein, 9 aa, Homo Sapiens
GQSAPSAPV

SEQ ID NO: 1384621 - protein, 9 aa, Homo Sapiens
LVKNVLKSH

SEQ ID NO: 1384622 - protein, 9 aa, Homo Sapiens
SPTSPKAQP

SEQ ID NO: 1384623 - protein, 9 aa, Homo Sapiens
EGGFWKLTP

SEQ ID NO: 1384624 - protein, 9 aa, Homo Sapiens
EVGLVHEAL

SEQ ID NO: 1384625 - protein, 9 aa, Homo Sapiens
KTKPTDTFL

SEQ ID NO: 1384626 - protein, 9 aa, Homo Sapiens
YWIQAHRLE

SEQ ID NO: 1384627 - protein, 9 aa, Homo Sapiens
RLIIPVELL

SEQ ID NO: 1384628 - protein, 9 aa, Homo Sapiens
VLVLVFMKM

SEQ ID NO: 1384629 - protein, 9 aa, Homo Sapiens
SHVPYWNSK

SEQ ID NO: 1384630 - protein, 9 aa, Homo Sapiens
ELKHWCPGL

SEQ ID NO: 1384631 - protein, 9 aa, Homo Sapiens
HKADMLEKE

SEQ ID NO: 1384632 - protein, 9 aa, Homo Sapiens
HPRAQCVVL

SEQ ID NO: 1384633 - protein, 9 aa, Homo Sapiens
TDLKIRGKL

SEQ ID NO: 1384634 - protein, 9 aa, Homo Sapiens
DGLDSGADT

SEQ ID NO: 1384635 - protein, 9 aa, Homo Sapiens
DHYPMFTEK

SEQ ID NO: 1384636 - protein, 9 aa, Homo Sapiens
LIDGVGIFS

SEQ ID NO: 1384637 - protein, 9 aa, Homo Sapiens
NIIGPLDAK

SEQ ID NO: 1384638 - protein, 9 aa, Homo Sapiens
HATNIMCSW

SEQ ID NO: 1384639 - protein, 9 aa, Homo Sapiens
FHDETAFFT

SEQ ID NO: 1384640 - protein, 9 aa, Homo Sapiens
KQGDTIECL

SEQ ID NO: 1384641 - protein, 9 aa, Homo Sapiens
RNNMMNKMR

SEQ ID NO: 1384642 - protein, 9 aa, Homo Sapiens
RGKELLQKT

SEQ ID NO: 1384643 - protein, 9 aa, Homo Sapiens
GAVHLAFSP

SEQ ID NO: 1384644 - protein, 9 aa, Homo Sapiens
DQWTPTKYL

SEQ ID NO: 1384645 - protein, 9 aa, Homo Sapiens
LSAGQNATV

SEQ ID NO: 1384646 - protein, 9 aa, Homo Sapiens
LWYHQVVGA

SEQ ID NO: 1384647 - protein, 9 aa, Homo Sapiens
GAAGQERRV

SEQ ID NO: 1384648 - protein, 9 aa, Homo Sapiens
LYNRRLKSM

SEQ ID NO: 1384649 - protein, 9 aa, Homo Sapiens
DEIHDLVKN

SEQ ID NO: 1384650 - protein, 9 aa, Homo Sapiens
GPHLPVTAF

SEQ ID NO: 1384651 - protein, 9 aa, Homo Sapiens
LNLDDRHWS

SEQ ID NO: 1384652 - protein, 9 aa, Homo Sapiens
LSHGPLGDR

SEQ ID NO: 1384653 - protein, 9 aa, Homo Sapiens
RDSRSFFTS

SEQ ID NO: 1384654 - protein, 9 aa, Homo Sapiens
IPEKKPEEE

SEQ ID NO: 1384655 - protein, 9 aa, Homo Sapiens
EPPRLPLKW

SEQ ID NO: 1384656 - protein, 9 aa, Homo Sapiens
VRRILINLM

SEQ ID NO: 1384657 - protein, 9 aa, Homo Sapiens
CNSSFSSTS

SEQ ID NO: 1384658 - protein, 9 aa, Homo Sapiens
HRLLCLEEP

SEQ ID NO: 1384659 - protein, 9 aa, Homo Sapiens
AWTCHWTIV

SEQ ID NO: 1384660 - protein, 9 aa, Homo Sapiens
IERLNNPPG

SEQ ID NO: 1384661 - protein, 9 aa, Homo Sapiens
EGWMPDQLY

SEQ ID NO: 1384662 - protein, 9 aa, Homo Sapiens
SWAWRSRAS

SEQ ID NO: 1384663 - protein, 9 aa, Homo Sapiens
RLALPATLL

SEQ ID NO: 1384664 - protein, 9 aa, Homo Sapiens
SDDGDPPRS

SEQ ID NO: 1384665 - protein, 9 aa, Homo Sapiens
KESHVPYWN

SEQ ID NO: 1384666 - protein, 9 aa, Homo Sapiens
RVSDLHPNT

SEQ ID NO: 1384667 - protein, 9 aa, Homo Sapiens
WELELKHWC

SEQ ID NO: 1384668 - protein, 9 aa, Homo Sapiens
RKHIIIPLE

SEQ ID NO: 1384669 - protein, 9 aa, Homo Sapiens
ITQHSIPAM

SEQ ID NO: 1384670 - protein, 9 aa, Homo Sapiens
IVCDGRLYA

SEQ ID NO: 1384671 - protein, 9 aa, Homo Sapiens
GSRIPSAPW

SEQ ID NO: 1384672 - protein, 9 aa, Homo Sapiens
AWKKRFAAC

SEQ ID NO: 1384673 - protein, 9 aa, Homo Sapiens
DFVPEKWRK

SEQ ID NO: 1384674 - protein, 9 aa, Homo Sapiens
RQWLHPEVR

SEQ ID NO: 1384675 - protein, 9 aa, Homo Sapiens
HPQTAMCDL

SEQ ID NO: 1384676 - protein, 9 aa, Homo Sapiens
RCEDEHFEL

SEQ ID NO: 1384677 - protein, 9 aa, Homo Sapiens
LWTLDLVLS

SEQ ID NO: 1384678 - protein, 9 aa, Homo Sapiens
VNPKILMTG

SEQ ID NO: 1384679 - protein, 9 aa, Homo Sapiens
KHMSHGEEL

SEQ ID NO: 1384680 - protein, 9 aa, Homo Sapiens
GEVQQVQLD

SEQ ID NO: 1384681 - protein, 9 aa, Homo Sapiens
VQKLRVLDR

SEQ ID NO: 1384682 - protein, 9 aa, Homo Sapiens
PTKIETLFE

SEQ ID NO: 1384683 - protein, 9 aa, Homo Sapiens
MQFQEPYLK

SEQ ID NO: 1384684 - protein, 9 aa, Homo Sapiens
RLTDVQQLV

SEQ ID NO: 1384685 - protein, 9 aa, Homo Sapiens
EITDIKPIL

SEQ ID NO: 1384686 - protein, 9 aa, Homo Sapiens
QTTQVNAWD

SEQ ID NO: 1384687 - protein, 9 aa, Homo Sapiens
DPEARAPTK

SEQ ID NO: 1384688 - protein, 9 aa, Homo Sapiens
YKMEYSYLD

SEQ ID NO: 1384689 - protein, 9 aa, Homo Sapiens
GRFGGRGTT

SEQ ID NO: 1384690 - protein, 9 aa, Homo Sapiens
VGIPQQCII

SEQ ID NO: 1384691 - protein, 9 aa, Homo Sapiens
ETAFFTNKR

SEQ ID NO: 1384692 - protein, 9 aa, Homo Sapiens
LLLWMSESP

SEQ ID NO: 1384693 - protein, 9 aa, Homo Sapiens
RLPPGAPFL

SEQ ID NO: 1384694 - protein, 9 aa, Homo Sapiens
DPEMAVKLH

SEQ ID NO: 1384695 - protein, 9 aa, Homo Sapiens
GQPPSPARA

SEQ ID NO: 1384696 - protein, 9 aa, Homo Sapiens
PPQQTRKTC

SEQ ID NO: 1384697 - protein, 9 aa, Homo Sapiens
SLCNFSCFF

SEQ ID NO: 1384698 - protein, 9 aa, Homo Sapiens
MGQTTQCLG

SEQ ID NO: 1384699 - protein, 9 aa, Homo Sapiens
DALCAVELK

SEQ ID NO: 1384700 - protein, 9 aa, Homo Sapiens
RVHHTDHPR

SEQ ID NO: 1384701 - protein, 9 aa, Homo Sapiens
GTHSPADDP

SEQ ID NO: 1384702 - protein, 9 aa, Homo Sapiens
AGRYFLWVV

SEQ ID NO: 1384703 - protein, 9 aa, Homo Sapiens
LMKRIAEIT

SEQ ID NO: 1384704 - protein, 9 aa, Homo Sapiens
VSSTGRPAS

SEQ ID NO: 1384705 - protein, 9 aa, Homo Sapiens
LSWRRSGTL

SEQ ID NO: 1384706 - protein, 9 aa, Homo Sapiens
PEIQLCLLC

SEQ ID NO: 1384707 - protein, 9 aa, Homo Sapiens
YRTAGVNIA

SEQ ID NO: 1384708 - protein, 9 aa, Homo Sapiens
HSNTLIQQA

SEQ ID NO: 1384709 - protein, 9 aa, Homo Sapiens
SPTTHRDML

SEQ ID NO: 1384710 - protein, 9 aa, Homo Sapiens
ISSQSFSHC

SEQ ID NO: 1384711 - protein, 9 aa, Homo Sapiens
GKLHQLIMN

SEQ ID NO: 1384712 - protein, 9 aa, Homo Sapiens
TAMPQMQLQ

SEQ ID NO: 1384713 - protein, 9 aa, Homo Sapiens
RIHQSPYGV

SEQ ID NO: 1384714 - protein, 9 aa, Homo Sapiens
DTPQPSLPG

SEQ ID NO: 1384715 - protein, 9 aa, Homo Sapiens
EAKRWEPFR

SEQ ID NO: 1384716 - protein, 9 aa, Homo Sapiens
KAPQREAST

SEQ ID NO: 1384717 - protein, 9 aa, Homo Sapiens
LTLAGPPRR

SEQ ID NO: 1384718 - protein, 9 aa, Homo Sapiens
LVLPKKICV

SEQ ID NO: 1384719 - protein, 9 aa, Homo Sapiens
SRSKTRGKN

SEQ ID NO: 1384720 - protein, 9 aa, Homo Sapiens
SKVKLRMSF

SEQ ID NO: 1384721 - protein, 9 aa, Homo Sapiens
RPCRMRLYQ

SEQ ID NO: 1384722 - protein, 9 aa, Homo Sapiens
FQMLLSSLS

SEQ ID NO: 1384723 - protein, 9 aa, Homo Sapiens
LESGMSQTV

SEQ ID NO: 1384724 - protein, 9 aa, Homo Sapiens
VPTQLVLSG

SEQ ID NO: 1384725 - protein, 9 aa, Homo Sapiens
IPIHDTISS

SEQ ID NO: 1384726 - protein, 9 aa, Homo Sapiens
HPEIQLCLL

SEQ ID NO: 1384727 - protein, 9 aa, Homo Sapiens
KEKNSREDK

SEQ ID NO: 1384728 - protein, 9 aa, Homo Sapiens
AGGHSGSET

SEQ ID NO: 1384729 - protein, 9 aa, Homo Sapiens
GAPFLRGLW

SEQ ID NO: 1384730 - protein, 9 aa, Homo Sapiens
TDHPRAQCV

SEQ ID NO: 1384731 - protein, 9 aa, Homo Sapiens
KGRYLRLST

SEQ ID NO: 1384732 - protein, 9 aa, Homo Sapiens
RPPWALMSP

SEQ ID NO: 1384733 - protein, 9 aa, Homo Sapiens
SCVQQPPYF

SEQ ID NO: 1384734 - protein, 9 aa, Homo Sapiens
SLHKLCCGS

SEQ ID NO: 1384735 - protein, 9 aa, Homo Sapiens
GLWCSAEPP

SEQ ID NO: 1384736 - protein, 9 aa, Homo Sapiens
HQSPYGVTA

SEQ ID NO: 1384737 - protein, 9 aa, Homo Sapiens
CVKALSYKF

SEQ ID NO: 1384738 - protein, 9 aa, Homo Sapiens
IGGIIGGFW

SEQ ID NO: 1384739 - protein, 9 aa, Homo Sapiens
FVGQISTLV

SEQ ID NO: 1384740 - protein, 9 aa, Homo Sapiens
VSVEFQGLI

SEQ ID NO: 1384741 - protein, 9 aa, Homo Sapiens
RSRSHGGRR

SEQ ID NO: 1384742 - protein, 9 aa, Homo Sapiens
NNLGFTPAD

SEQ ID NO: 1384743 - protein, 9 aa, Homo Sapiens
TGQQDGAAS

SEQ ID NO: 1384744 - protein, 9 aa, Homo Sapiens
YKRAKVLDQ

SEQ ID NO: 1384745 - protein, 9 aa, Homo Sapiens
TIWLFKHHR

SEQ ID NO: 1384746 - protein, 9 aa, Homo Sapiens
LKHWCPGLK

SEQ ID NO: 1384747 - protein, 9 aa, Homo Sapiens
EKPKHHYSN

SEQ ID NO: 1384748 - protein, 9 aa, Homo Sapiens
KKLNLSTIL

SEQ ID NO: 1384749 - protein, 9 aa, Homo Sapiens
LVTLITIWV

SEQ ID NO: 1384750 - protein, 9 aa, Homo Sapiens
VAHCFAPRG

SEQ ID NO: 1384751 - protein, 9 aa, Homo Sapiens
HCTVAVPKG

SEQ ID NO: 1384752 - protein, 9 aa, Homo Sapiens
TIRNQGSIS

SEQ ID NO: 1384753 - protein, 9 aa, Homo Sapiens
PTTHLQARL

SEQ ID NO: 1384754 - protein, 9 aa, Homo Sapiens
SGILEHYVL

SEQ ID NO: 1384755 - protein, 9 aa, Homo Sapiens
YIRNLKSCI

SEQ ID NO: 1384756 - protein, 9 aa, Homo Sapiens
SETQWKVTV

SEQ ID NO: 1384757 - protein, 9 aa, Homo Sapiens
GRGWQKRTQ

SEQ ID NO: 1384758 - protein, 9 aa, Homo Sapiens
VYLAAVLEC

SEQ ID NO: 1384759 - protein, 9 aa, Homo Sapiens
LLTLMDDIG

SEQ ID NO: 1384760 - protein, 9 aa, Homo Sapiens
FHGDHSTDK

SEQ ID NO: 1384761 - protein, 9 aa, Homo Sapiens
CPKHVNLCA

SEQ ID NO: 1384762 - protein, 9 aa, Homo Sapiens
TPPTCPRAY

SEQ ID NO: 1384763 - protein, 9 aa, Homo Sapiens
QILGKYKEV

SEQ ID NO: 1384764 - protein, 9 aa, Homo Sapiens
GPPACRLHA

SEQ ID NO: 1384765 - protein, 9 aa, Homo Sapiens
PAPWLPMRS

SEQ ID NO: 1384766 - protein, 9 aa, Homo Sapiens
HTLSALPSP

SEQ ID NO: 1384767 - protein, 9 aa, Homo Sapiens
GWCLTGTHP

SEQ ID NO: 1384768 - protein, 9 aa, Homo Sapiens
QAEIQKECL

SEQ ID NO: 1384769 - protein, 9 aa, Homo Sapiens
TLGLVVSLW

SEQ ID NO: 1384770 - protein, 9 aa, Homo Sapiens
RKTKISRKM

SEQ ID NO: 1384771 - protein, 9 aa, Homo Sapiens
IDKSQLDAA

SEQ ID NO: 1384772 - protein, 9 aa, Homo Sapiens
WDINAVCAD

SEQ ID NO: 1384773 - protein, 9 aa, Homo Sapiens
QFPFTSPTI

SEQ ID NO: 1384774 - protein, 9 aa, Homo Sapiens
ALSEGLFQH

SEQ ID NO: 1384775 - protein, 9 aa, Homo Sapiens
LCLINYYES

SEQ ID NO: 1384776 - protein, 9 aa, Homo Sapiens
RSRLEVMHG

SEQ ID NO: 1384777 - protein, 9 aa, Homo Sapiens
VCVAGVHYQ

SEQ ID NO: 1384778 - protein, 9 aa, Homo Sapiens
LGEPWRAGF

SEQ ID NO: 1384779 - protein, 9 aa, Homo Sapiens
IECLKRHNA

SEQ ID NO: 1384780 - protein, 9 aa, Homo Sapiens
RIFITTIFM

SEQ ID NO: 1384781 - protein, 9 aa, Homo Sapiens
TTPSTDLKI

SEQ ID NO: 1384782 - protein, 9 aa, Homo Sapiens
LVVVEGVHG

SEQ ID NO: 1384783 - protein, 9 aa, Homo Sapiens
LWRPTAIRQ

SEQ ID NO: 1384784 - protein, 9 aa, Homo Sapiens
DVWCNGKKI

SEQ ID NO: 1384785 - protein, 9 aa, Homo Sapiens
GSHASTHDN

SEQ ID NO: 1384786 - protein, 9 aa, Homo Sapiens
AGTNKPPGA

SEQ ID NO: 1384787 - protein, 9 aa, Homo Sapiens
LHSQEEDFH

SEQ ID NO: 1384788 - protein, 9 aa, Homo Sapiens
TLSKKNPGV

SEQ ID NO: 1384789 - protein, 9 aa, Homo Sapiens
EPRQAEIQK

SEQ ID NO: 1384790 - protein, 9 aa, Homo Sapiens
MTIKFAPAN

SEQ ID NO: 1384791 - protein, 9 aa, Homo Sapiens
LGRNPTLFP

SEQ ID NO: 1384792 - protein, 9 aa, Homo Sapiens
LRESIKREI

SEQ ID NO: 1384793 - protein, 9 aa, Homo Sapiens
EQQEWLLAM

SEQ ID NO: 1384794 - protein, 9 aa, Homo Sapiens
DCDKIKQFA

SEQ ID NO: 1384795 - protein, 9 aa, Homo Sapiens
SLSQNDAYN

SEQ ID NO: 1384796 - protein, 9 aa, Homo Sapiens
AQALKNSFE

SEQ ID NO: 1384797 - protein, 9 aa, Homo Sapiens
FNMLEALSE

SEQ ID NO: 1384798 - protein, 9 aa, Homo Sapiens
RRSRSHGGR

SEQ ID NO: 1384799 - protein, 9 aa, Homo Sapiens
SSSDTFFNS

SEQ ID NO: 1384800 - protein, 9 aa, Homo Sapiens
CADGTDFPS

SEQ ID NO: 1384801 - protein, 9 aa, Homo Sapiens
PLPERAGAS

SEQ ID NO: 1384802 - protein, 9 aa, Homo Sapiens
LSYKEDMKE

SEQ ID NO: 1384803 - protein, 9 aa, Homo Sapiens
RPGHRHPQT

SEQ ID NO: 1384804 - protein, 9 aa, Homo Sapiens
CPGEQLRNA

SEQ ID NO: 1384805 - protein, 9 aa, Homo Sapiens
THDNLPELY

SEQ ID NO: 1384806 - protein, 9 aa, Homo Sapiens
QRQPWVLRV

SEQ ID NO: 1384807 - protein, 9 aa, Homo Sapiens
IWKVWQRRK

SEQ ID NO: 1384808 - protein, 9 aa, Homo Sapiens
LQSGRPGGE

SEQ ID NO: 1384809 - protein, 9 aa, Homo Sapiens
TFETTFPSS

SEQ ID NO: 1384810 - protein, 9 aa, Homo Sapiens
PSSCTYSAL

SEQ ID NO: 1384811 - protein, 9 aa, Homo Sapiens
HLEGTAYGP

SEQ ID NO: 1384812 - protein, 9 aa, Homo Sapiens
IINPTISCP

SEQ ID NO: 1384813 - protein, 9 aa, Homo Sapiens
VEMVQQTTY

SEQ ID NO: 1384814 - protein, 9 aa, Homo Sapiens
QQHFWTSAG

SEQ ID NO: 1384815 - protein, 9 aa, Homo Sapiens
CLKRHNALL

SEQ ID NO: 1384816 - protein, 9 aa, Homo Sapiens
RSTATSSSC

SEQ ID NO: 1384817 - protein, 9 aa, Homo Sapiens
QTPHYIRRH

SEQ ID NO: 1384818 - protein, 9 aa, Homo Sapiens
GLASVGATG

SEQ ID NO: 1384819 - protein, 9 aa, Homo Sapiens
PGTDIPIHD

SEQ ID NO: 1384820 - protein, 9 aa, Homo Sapiens
RMGVVPPST

SEQ ID NO: 1384821 - protein, 9 aa, Homo Sapiens
CDMYVKVFY

SEQ ID NO: 1384822 - protein, 9 aa, Homo Sapiens
RKEWQRQPL

SEQ ID NO: 1384823 - protein, 9 aa, Homo Sapiens
QPWDINAVC

SEQ ID NO: 1384824 - protein, 9 aa, Homo Sapiens
KAMLMAVDW

SEQ ID NO: 1384825 - protein, 9 aa, Homo Sapiens
RRKNNFRLR

SEQ ID NO: 1384826 - protein, 9 aa, Homo Sapiens
AQPASSTRP

SEQ ID NO: 1384827 - protein, 9 aa, Homo Sapiens
TTAAKRKWK

SEQ ID NO: 1384828 - protein, 9 aa, Homo Sapiens
FHVRFDLLG

SEQ ID NO: 1384829 - protein, 9 aa, Homo Sapiens
VSDLHPNTK

SEQ ID NO: 1384830 - protein, 9 aa, Homo Sapiens
MTSRYNDGR

SEQ ID NO: 1384831 - protein, 9 aa, Homo Sapiens
PSQPPSPSS

SEQ ID NO: 1384832 - protein, 9 aa, Homo Sapiens
KKSDGIWKV

SEQ ID NO: 1384833 - protein, 9 aa, Homo Sapiens
GPGQSAPSA

SEQ ID NO: 1384834 - protein, 9 aa, Homo Sapiens
LIQPCIQII

SEQ ID NO: 1384835 - protein, 9 aa, Homo Sapiens
LLVVMSFDR

SEQ ID NO: 1384836 - protein, 9 aa, Homo Sapiens
ELHLATAWP

SEQ ID NO: 1384837 - protein, 9 aa, Homo Sapiens
DQDWEFMVF

SEQ ID NO: 1384838 - protein, 9 aa, Homo Sapiens
CLLLVVMSF

SEQ ID NO: 1384839 - protein, 9 aa, Homo Sapiens
RPSVSISPS

SEQ ID NO: 1384840 - protein, 9 aa, Homo Sapiens
YPGFTKHLF

SEQ ID NO: 1384841 - protein, 9 aa, Homo Sapiens
WLERAYGRL

SEQ ID NO: 1384842 - protein, 9 aa, Homo Sapiens
RHFQKVLNW

SEQ ID NO: 1384843 - protein, 9 aa, Homo Sapiens
KDVPEGLGR

SEQ ID NO: 1384844 - protein, 9 aa, Homo Sapiens
SPSNFKVHF

SEQ ID NO: 1384845 - protein, 9 aa, Homo Sapiens
RQPSYNIKS

SEQ ID NO: 1384846 - protein, 9 aa, Homo Sapiens
KNILPKSTW

SEQ ID NO: 1384847 - protein, 9 aa, Homo Sapiens
TEEMEPSRS

SEQ ID NO: 1384848 - protein, 9 aa, Homo Sapiens
RFSSPRISV

SEQ ID NO: 1384849 - protein, 9 aa, Homo Sapiens
LSSLSQNDA

SEQ ID NO: 1384850 - protein, 9 aa, Homo Sapiens
VLFKLLWDR

SEQ ID NO: 1384851 - protein, 9 aa, Homo Sapiens
TGRRQSRHS

SEQ ID NO: 1384852 - protein, 9 aa, Homo Sapiens
LLQKTIRNQ

SEQ ID NO: 1384853 - protein, 9 aa, Homo Sapiens
FQIFDNMKL

SEQ ID NO: 1384854 - protein, 9 aa, Homo Sapiens
LTIFGNSAM

SEQ ID NO: 1384855 - protein, 9 aa, Homo Sapiens
SNSTVSETQ

SEQ ID NO: 1384856 - protein, 9 aa, Homo Sapiens
AGEEGPGLG

SEQ ID NO: 1384857 - protein, 9 aa, Homo Sapiens
LFHIDFEDP

SEQ ID NO: 1384858 - protein, 9 aa, Homo Sapiens
SHKVLAWWF

SEQ ID NO: 1384859 - protein, 9 aa, Homo Sapiens
NCGEGTTVS

SEQ ID NO: 1384860 - protein, 9 aa, Homo Sapiens
RYVTPWTLL

SEQ ID NO: 1384861 - protein, 9 aa, Homo Sapiens
GKAYISCSS

SEQ ID NO: 1384862 - protein, 9 aa, Homo Sapiens
TLYPGFTKH

SEQ ID NO: 1384863 - protein, 9 aa, Homo Sapiens
VNRIDETKH

SEQ ID NO: 1384864 - protein, 9 aa, Homo Sapiens
QCGSQPWDI

SEQ ID NO: 1384865 - protein, 9 aa, Homo Sapiens
PGAGEEGPG

SEQ ID NO: 1384866 - protein, 9 aa, Homo Sapiens
QWKVTVTPR

SEQ ID NO: 1384867 - protein, 9 aa, Homo Sapiens
PRLLTRQDV

SEQ ID NO: 1384868 - protein, 9 aa, Homo Sapiens
PAWLSPISA

SEQ ID NO: 1384869 - protein, 9 aa, Homo Sapiens
TSVYPHFLL

SEQ ID NO: 1384870 - protein, 9 aa, Homo Sapiens
DVRMVADEY

SEQ ID NO: 1384871 - protein, 9 aa, Homo Sapiens
VSPDVPDMA

SEQ ID NO: 1384872 - protein, 9 aa, Homo Sapiens
GDMSNRHVC

SEQ ID NO: 1384873 - protein, 9 aa, Homo Sapiens
AVNMVGCLA

SEQ ID NO: 1384874 - protein, 9 aa, Homo Sapiens
TQFHSLRRD

SEQ ID NO: 1384875 - protein, 9 aa, Homo Sapiens
SLYSVAVWP

SEQ ID NO: 1384876 - protein, 9 aa, Homo Sapiens
IAEITDIKP

SEQ ID NO: 1384877 - protein, 9 aa, Homo Sapiens
AWVSFSLCG

SEQ ID NO: 1384878 - protein, 9 aa, Homo Sapiens
LYMQFQEPY

SEQ ID NO: 1384879 - protein, 9 aa, Homo Sapiens
ISGVEIHCE

SEQ ID NO: 1384880 - protein, 9 aa, Homo Sapiens
SLGGLRANT

SEQ ID NO: 1384881 - protein, 9 aa, Homo Sapiens
FLGSPKRQK

SEQ ID NO: 1384882 - protein, 9 aa, Homo Sapiens
ITVSFVGQI

SEQ ID NO: 1384883 - protein, 9 aa, Homo Sapiens
RGLWCSAEP

SEQ ID NO: 1384884 - protein, 9 aa, Homo Sapiens
NTRVENVNP

SEQ ID NO: 1384885 - protein, 9 aa, Homo Sapiens
QSLLSLYSV

SEQ ID NO: 1384886 - protein, 9 aa, Homo Sapiens
YCAPSNKSV

SEQ ID NO: 1384887 - protein, 9 aa, Homo Sapiens
LLGQPMILA

SEQ ID NO: 1384888 - protein, 9 aa, Homo Sapiens
FCGCAERVG

SEQ ID NO: 1384889 - protein, 9 aa, Homo Sapiens
NPAAQDGAR

SEQ ID NO: 1384890 - protein, 9 aa, Homo Sapiens
AMKVQSQAP

SEQ ID NO: 1384891 - protein, 9 aa, Homo Sapiens
RGKAFILGS

SEQ ID NO: 1384892 - protein, 9 aa, Homo Sapiens
PMDSKGDES

SEQ ID NO: 1384893 - protein, 9 aa, Homo Sapiens
GICKNHDQH

SEQ ID NO: 1384894 - protein, 9 aa, Homo Sapiens
QCDKKRGAS

SEQ ID NO: 1384895 - protein, 9 aa, Homo Sapiens
KAFVTLASQ

SEQ ID NO: 1384896 - protein, 9 aa, Homo Sapiens
EDGVNPAVR

SEQ ID NO: 1384897 - protein, 9 aa, Homo Sapiens
NKPPIQMPG

SEQ ID NO: 1384898 - protein, 9 aa, Homo Sapiens
HQVVGAQRC

SEQ ID NO: 1384899 - protein, 9 aa, Homo Sapiens
AQPKKKATK

SEQ ID NO: 1384900 - protein, 9 aa, Homo Sapiens
WKQSQQSLS

SEQ ID NO: 1384901 - protein, 9 aa, Homo Sapiens
GPAAALCSA

SEQ ID NO: 1384902 - protein, 9 aa, Homo Sapiens
QGFLILPGS

SEQ ID NO: 1384903 - protein, 9 aa, Homo Sapiens
IPDKEVRQA

SEQ ID NO: 1384904 - protein, 9 aa, Homo Sapiens
APSNKSVDV

SEQ ID NO: 1384905 - protein, 9 aa, Homo Sapiens
LRHALSHGP

SEQ ID NO: 1384906 - protein, 9 aa, Homo Sapiens
KGRSHVQVG

SEQ ID NO: 1384907 - protein, 9 aa, Homo Sapiens
QPPTLGCSM

SEQ ID NO: 1384908 - protein, 9 aa, Homo Sapiens
LPLKWKELI

SEQ ID NO: 1384909 - protein, 9 aa, Homo Sapiens
RGLQGPPGI

SEQ ID NO: 1384910 - protein, 9 aa, Homo Sapiens
TLGCSMQMR

SEQ ID NO: 1384911 - protein, 9 aa, Homo Sapiens
AEEEKKEDK

SEQ ID NO: 1384912 - protein, 9 aa, Homo Sapiens
LLSAIVSIS

SEQ ID NO: 1384913 - protein, 9 aa, Homo Sapiens
EIPTGSEAD

SEQ ID NO: 1384914 - protein, 9 aa, Homo Sapiens
SETGLCGAT

SEQ ID NO: 1384915 - protein, 9 aa, Homo Sapiens
SQVDPEMAV

SEQ ID NO: 1384916 - protein, 9 aa, Homo Sapiens
QLHGMRKGA

SEQ ID NO: 1384917 - protein, 9 aa, Homo Sapiens
LHHGSQYEA

SEQ ID NO: 1384918 - protein, 9 aa, Homo Sapiens
RRAALKSAR

SEQ ID NO: 1384919 - protein, 9 aa, Homo Sapiens
HNWLPARAL

SEQ ID NO: 1384920 - protein, 9 aa, Homo Sapiens
ISRKMRNPT

SEQ ID NO: 1384921 - protein, 9 aa, Homo Sapiens
ISDNSSRQV

SEQ ID NO: 1384922 - protein, 9 aa, Homo Sapiens
KHHRARFLH

SEQ ID NO: 1384923 - protein, 9 aa, Homo Sapiens
QLSEDVQAA

SEQ ID NO: 1384924 - protein, 9 aa, Homo Sapiens
DFHGDHSTD

SEQ ID NO: 1384925 - protein, 9 aa, Homo Sapiens
LNLSTILIL

SEQ ID NO: 1384926 - protein, 9 aa, Homo Sapiens
QGRRWGAWH

SEQ ID NO: 1384927 - protein, 9 aa, Homo Sapiens
SKVESSYRS

SEQ ID NO: 1384928 - protein, 9 aa, Homo Sapiens
CPRLLPYPF

SEQ ID NO: 1384929 - protein, 9 aa, Homo Sapiens
IATGNRELL

SEQ ID NO: 1384930 - protein, 9 aa, Homo Sapiens
WPERGLPPA

SEQ ID NO: 1384931 - protein, 9 aa, Homo Sapiens
IEEHFGPDA

SEQ ID NO: 1384932 - protein, 9 aa, Homo Sapiens
RMSVRIVKN

SEQ ID NO: 1384933 - protein, 9 aa, Homo Sapiens
GGRHHHHPL

SEQ ID NO: 1384934 - protein, 9 aa, Homo Sapiens
RSEGKGRSH

SEQ ID NO: 1384935 - protein, 9 aa, Homo Sapiens
RHALSHGPL

SEQ ID NO: 1384936 - protein, 9 aa, Homo Sapiens
HKLWMIVII

SEQ ID NO: 1384937 - protein, 9 aa, Homo Sapiens
WDLLRFLLI

SEQ ID NO: 1384938 - protein, 9 aa, Homo Sapiens
LCSSKSTTE

SEQ ID NO: 1384939 - protein, 9 aa, Homo Sapiens
CPFQSPTKR

SEQ ID NO: 1384940 - protein, 9 aa, Homo Sapiens
AEGEMRGVF

SEQ ID NO: 1384941 - protein, 9 aa, Homo Sapiens
GMSQTVTQS

SEQ ID NO: 1384942 - protein, 9 aa, Homo Sapiens
QVLPGLDVV

SEQ ID NO: 1384943 - protein, 9 aa, Homo Sapiens
QCTQGRRWG

SEQ ID NO: 1384944 - protein, 9 aa, Homo Sapiens
KHYLSAQRE

SEQ ID NO: 1384945 - protein, 9 aa, Homo Sapiens
QKECLRLWG

SEQ ID NO: 1384946 - protein, 9 aa, Homo Sapiens
KLMSFEDFL

SEQ ID NO: 1384947 - protein, 9 aa, Homo Sapiens
AVSQVNRID

SEQ ID NO: 1384948 - protein, 9 aa, Homo Sapiens
QQGQGSHYG

SEQ ID NO: 1384949 - protein, 9 aa, Homo Sapiens
VSGGPPTSD

SEQ ID NO: 1384950 - protein, 9 aa, Homo Sapiens
SQTNALIGG

SEQ ID NO: 1384951 - protein, 9 aa, Homo Sapiens
SLIDGVGIF

SEQ ID NO: 1384952 - protein, 9 aa, Homo Sapiens
WRSTGGWPT

SEQ ID NO: 1384953 - protein, 9 aa, Homo Sapiens
ATLRCPAVP

SEQ ID NO: 1384954 - protein, 9 aa, Homo Sapiens
KGFSESSHL

SEQ ID NO: 1384955 - protein, 9 aa, Homo Sapiens
MHSSERPYK

SEQ ID NO: 1384956 - protein, 9 aa, Homo Sapiens
TKKRGKSQG

SEQ ID NO: 1384957 - protein, 9 aa, Homo Sapiens
IFGNSAMSQ

SEQ ID NO: 1384958 - protein, 9 aa, Homo Sapiens
ASPWLPIPV

SEQ ID NO: 1384959 - protein, 9 aa, Homo Sapiens
IVGSYLVPP

SEQ ID NO: 1384960 - protein, 9 aa, Homo Sapiens
ESGGVVDNN

SEQ ID NO: 1384961 - protein, 9 aa, Homo Sapiens
ELLVGRLMN

SEQ ID NO: 1384962 - protein, 9 aa, Homo Sapiens
LTLGATSAA

SEQ ID NO: 1384963 - protein, 9 aa, Homo Sapiens
HSFLLTIMG

SEQ ID NO: 1384964 - protein, 9 aa, Homo Sapiens
STATSSSCS

SEQ ID NO: 1384965 - protein, 9 aa, Homo Sapiens
QLAWVSFSL

SEQ ID NO: 1384966 - protein, 9 aa, Homo Sapiens
QDVGIWYLF

SEQ ID NO: 1384967 - protein, 9 aa, Homo Sapiens
DSPEVGLVH

SEQ ID NO: 1384968 - protein, 9 aa, Homo Sapiens
PKHHYSNAR

SEQ ID NO: 1384969 - protein, 9 aa, Homo Sapiens
GRHVLDGLH

SEQ ID NO: 1384970 - protein, 9 aa, Homo Sapiens
SITEDLTSQ

SEQ ID NO: 1384971 - protein, 9 aa, Homo Sapiens
VALSWRGLH

SEQ ID NO: 1384972 - protein, 9 aa, Homo Sapiens
AVCHVDATG

SEQ ID NO: 1384973 - protein, 9 aa, Homo Sapiens
ASTPVRKPH

SEQ ID NO: 1384974 - protein, 9 aa, Homo Sapiens
LVACPDLRR

SEQ ID NO: 1384975 - protein, 9 aa, Homo Sapiens
KKSHIKWIC

SEQ ID NO: 1384976 - protein, 9 aa, Homo Sapiens
ELKEARHAL

SEQ ID NO: 1384977 - protein, 9 aa, Homo Sapiens
ESSKNAEPV

SEQ ID NO: 1384978 - protein, 9 aa, Homo Sapiens
APPTVSQAR

SEQ ID NO: 1384979 - protein, 9 aa, Homo Sapiens
EGSEFLLLW

SEQ ID NO: 1384980 - protein, 9 aa, Homo Sapiens
PYRTAGVNI

SEQ ID NO: 1384981 - protein, 9 aa, Homo Sapiens
DGIWKVWQR

SEQ ID NO: 1384982 - protein, 9 aa, Homo Sapiens
IGSISGHVR

SEQ ID NO: 1384983 - protein, 9 aa, Homo Sapiens
GRPGREPPP

SEQ ID NO: 1384984 - protein, 9 aa, Homo Sapiens
KKRFAACWS

SEQ ID NO: 1384985 - protein, 9 aa, Homo Sapiens
GRILLQRNL

SEQ ID NO: 1384986 - protein, 9 aa, Homo Sapiens
INPLLSILQ

SEQ ID NO: 1384987 - protein, 9 aa, Homo Sapiens
NLFAFTPIS

SEQ ID NO: 1384988 - protein, 9 aa, Homo Sapiens
RAQCVVLEA

SEQ ID NO: 1384989 - protein, 9 aa, Homo Sapiens
AGSVGAGTW

SEQ ID NO: 1384990 - protein, 9 aa, Homo Sapiens
EGEDALVTR

SEQ ID NO: 1384991 - protein, 9 aa, Homo Sapiens
TAIPTVLSS

SEQ ID NO: 1384992 - protein, 9 aa, Homo Sapiens
FIIRDTIPN

SEQ ID NO: 1384993 - protein, 9 aa, Homo Sapiens
PWTLLILTT

SEQ ID NO: 1384994 - protein, 9 aa, Homo Sapiens
PNLTTKKCL

SEQ ID NO: 1384995 - protein, 9 aa, Homo Sapiens
DRPSVSISP

SEQ ID NO: 1384996 - protein, 9 aa, Homo Sapiens
PPGPNEAPP

SEQ ID NO: 1384997 - protein, 9 aa, Homo Sapiens
MKCVGHEED

SEQ ID NO: 1384998 - protein, 9 aa, Homo Sapiens
VKTRSEWQL

SEQ ID NO: 1384999 - protein, 9 aa, Homo Sapiens
KEAICKAGG

SEQ ID NO: 1385000 - protein, 9 aa, Homo Sapiens
LSRILPELG

SEQ ID NO: 1385001 - protein, 9 aa, Homo Sapiens
IQKECLRLW

SEQ ID NO: 1385002 - protein, 9 aa, Homo Sapiens
KGKRSHLWT

SEQ ID NO: 1385003 - protein, 9 aa, Homo Sapiens
GSCSSWRRA

SEQ ID NO: 1385004 - protein, 9 aa, Homo Sapiens
KPKHHYSNA

SEQ ID NO: 1385005 - protein, 9 aa, Homo Sapiens
CCGKVSFQP

SEQ ID NO: 1385006 - protein, 9 aa, Homo Sapiens
SLGRCGCSP

SEQ ID NO: 1385007 - protein, 9 aa, Homo Sapiens
RSKVESSYR

SEQ ID NO: 1385008 - protein, 9 aa, Homo Sapiens
PPRVECLEE

SEQ ID NO: 1385009 - protein, 9 aa, Homo Sapiens
RCPAVPAAA

SEQ ID NO: 1385010 - protein, 9 aa, Homo Sapiens
DIRRSKNRI

SEQ ID NO: 1385011 - protein, 9 aa, Homo Sapiens
VCVMLDLAG

SEQ ID NO: 1385012 - protein, 9 aa, Homo Sapiens
WYNDSVEHR

SEQ ID NO: 1385013 - protein, 9 aa, Homo Sapiens
RNNLGFTPA

SEQ ID NO: 1385014 - protein, 9 aa, Homo Sapiens
DKEVRQAVE

SEQ ID NO: 1385015 - protein, 9 aa, Homo Sapiens
IVFQIFDNM

SEQ ID NO: 1385016 - protein, 9 aa, Homo Sapiens
LQQWKRPMG

SEQ ID NO: 1385017 - protein, 9 aa, Homo Sapiens
TRPPAPPTV

SEQ ID NO: 1385018 - protein, 9 aa, Homo Sapiens
LGFLEPGEA

SEQ ID NO: 1385019 - protein, 9 aa, Homo Sapiens
NSAQGIREL

SEQ ID NO: 1385020 - protein, 9 aa, Homo Sapiens
ASDGATWTD

SEQ ID NO: 1385021 - protein, 9 aa, Homo Sapiens
RLPKLKHMS

SEQ ID NO: 1385022 - protein, 9 aa, Homo Sapiens
GVGMLGSWY

SEQ ID NO: 1385023 - protein, 9 aa, Homo Sapiens
ATCSWMTWS

SEQ ID NO: 1385024 - protein, 9 aa, Homo Sapiens
DEEDGDEVE

SEQ ID NO: 1385025 - protein, 9 aa, Homo Sapiens
MDDIGSEVS

SEQ ID NO: 1385026 - protein, 9 aa, Homo Sapiens
GQKYHSVCH

SEQ ID NO: 1385027 - protein, 9 aa, Homo Sapiens
PSDHIKRPV

SEQ ID NO: 1385028 - protein, 9 aa, Homo Sapiens
KASAIAIKL

SEQ ID NO: 1385029 - protein, 9 aa, Homo Sapiens
PLGDRCAGI

SEQ ID NO: 1385030 - protein, 9 aa, Homo Sapiens
DFLVCGNRR

SEQ ID NO: 1385031 - protein, 9 aa, Homo Sapiens
RRDHAAALP

SEQ ID NO: 1385032 - protein, 9 aa, Homo Sapiens
PSPPWSPST

SEQ ID NO: 1385033 - protein, 9 aa, Homo Sapiens
FPWGTLSIA

SEQ ID NO: 1385034 - protein, 9 aa, Homo Sapiens
KREEECSPA

SEQ ID NO: 1385035 - protein, 9 aa, Homo Sapiens
QPTLPLPLV

SEQ ID NO: 1385036 - protein, 9 aa, Homo Sapiens
ERAGDIQTT

SEQ ID NO: 1385037 - protein, 9 aa, Homo Sapiens
NSYLALATL

SEQ ID NO: 1385038 - protein, 9 aa, Homo Sapiens
EGSWSWQVS

SEQ ID NO: 1385039 - protein, 9 aa, Homo Sapiens
DHSRLQKVP

SEQ ID NO: 1385040 - protein, 9 aa, Homo Sapiens
QNVRRILIN

SEQ ID NO: 1385041 - protein, 9 aa, Homo Sapiens
PGQPTALFQ

SEQ ID NO: 1385042 - protein, 9 aa, Homo Sapiens
APPPAPPAA

SEQ ID NO: 1385043 - protein, 9 aa, Homo Sapiens
QPASSTRPA

SEQ ID NO: 1385044 - protein, 9 aa, Homo Sapiens
LIPSLSRSL

SEQ ID NO: 1385045 - protein, 9 aa, Homo Sapiens
KLTFRVAIR

SEQ ID NO: 1385046 - protein, 9 aa, Homo Sapiens
TFPPGTAMP

SEQ ID NO: 1385047 - protein, 9 aa, Homo Sapiens
IIPLERRSP

SEQ ID NO: 1385048 - protein, 9 aa, Homo Sapiens
YMQFQEPYL

SEQ ID NO: 1385049 - protein, 9 aa, Homo Sapiens
KHATNIMCS

SEQ ID NO: 1385050 - protein, 9 aa, Homo Sapiens
TYIIFFSPG

SEQ ID NO: 1385051 - protein, 9 aa, Homo Sapiens
FSESSHLQA

SEQ ID NO: 1385052 - protein, 9 aa, Homo Sapiens
CEFEGCDWR

SEQ ID NO: 1385053 - protein, 9 aa, Homo Sapiens
GAGTWTTTS

SEQ ID NO: 1385054 - protein, 9 aa, Homo Sapiens
ARGIKEPNS

SEQ ID NO: 1385055 - protein, 9 aa, Homo Sapiens
TTASALTLG

SEQ ID NO: 1385056 - protein, 9 aa, Homo Sapiens
SEHKLLPLY

SEQ ID NO: 1385057 - protein, 9 aa, Homo Sapiens
YECKQCVKA

SEQ ID NO: 1385058 - protein, 9 aa, Homo Sapiens
VLLMLGLLI

SEQ ID NO: 1385059 - protein, 9 aa, Homo Sapiens
RSHGGRRRR

SEQ ID NO: 1385060 - protein, 9 aa, Homo Sapiens
SLKRSKEPN

SEQ ID NO: 1385061 - protein, 9 aa, Homo Sapiens
MGWPRFWAC

SEQ ID NO: 1385062 - protein, 9 aa, Homo Sapiens
TGDQDRAPH

SEQ ID NO: 1385063 - protein, 9 aa, Homo Sapiens
DNLVVVEGV

SEQ ID NO: 1385064 - protein, 9 aa, Homo Sapiens
NVNPYEVKR

SEQ ID NO: 1385065 - protein, 9 aa, Homo Sapiens
HQKKLNLST

SEQ ID NO: 1385066 - protein, 9 aa, Homo Sapiens
SSTSSFEQH

SEQ ID NO: 1385067 - protein, 9 aa, Homo Sapiens
GHQASPTKI

SEQ ID NO: 1385068 - protein, 9 aa, Homo Sapiens
EEIFGRITT

SEQ ID NO: 1385069 - protein, 9 aa, Homo Sapiens
GLGRLPPGA

SEQ ID NO: 1385070 - protein, 9 aa, Homo Sapiens
PWLPIPVRP

SEQ ID NO: 1385071 - protein, 9 aa, Homo Sapiens
PFFVPMSLA

SEQ ID NO: 1385072 - protein, 9 aa, Homo Sapiens
MDRETKEEY

SEQ ID NO: 1385073 - protein, 9 aa, Homo Sapiens
HHFHTHPIP

SEQ ID NO: 1385074 - protein, 9 aa, Homo Sapiens
MVNGVQSCK

SEQ ID NO: 1385075 - protein, 9 aa, Homo Sapiens
RSWPTAAPP

SEQ ID NO: 1385076 - protein, 9 aa, Homo Sapiens
SWRRSRTSG

SEQ ID NO: 1385077 - protein, 9 aa, Homo Sapiens
DGGSNRGDA

SEQ ID NO: 1385078 - protein, 9 aa, Homo Sapiens
EAELGDASK

SEQ ID NO: 1385079 - protein, 9 aa, Homo Sapiens
LLSILQHAA

SEQ ID NO: 1385080 - protein, 9 aa, Homo Sapiens
FCSLKQVHL

SEQ ID NO: 1385081 - protein, 9 aa, Homo Sapiens
QGPPPQGKP

SEQ ID NO: 1385082 - protein, 9 aa, Homo Sapiens
PPEDSPPRG

SEQ ID NO: 1385083 - protein, 9 aa, Homo Sapiens
LAVNMVGCL

SEQ ID NO: 1385084 - protein, 9 aa, Homo Sapiens
ISRPPVTAN

SEQ ID NO: 1385085 - protein, 9 aa, Homo Sapiens
ALPNMDRET

SEQ ID NO: 1385086 - protein, 9 aa, Homo Sapiens
FVFNFFWVG

SEQ ID NO: 1385087 - protein, 9 aa, Homo Sapiens
ATWTDIFKR

SEQ ID NO: 1385088 - protein, 9 aa, Homo Sapiens
LAVVQKLRV

SEQ ID NO: 1385089 - protein, 9 aa, Homo Sapiens
GCAFVVSQV

SEQ ID NO: 1385090 - protein, 9 aa, Homo Sapiens
PSCKMTGKI

SEQ ID NO: 1385091 - protein, 9 aa, Homo Sapiens
QCLTEYMEH

SEQ ID NO: 1385092 - protein, 9 aa, Homo Sapiens
SARMTVTRR

SEQ ID NO: 1385093 - protein, 9 aa, Homo Sapiens
IAGSSLCST

SEQ ID NO: 1385094 - protein, 9 aa, Homo Sapiens
QICLKKGIK

SEQ ID NO: 1385095 - protein, 9 aa, Homo Sapiens
PQAQLQGFL

SEQ ID NO: 1385096 - protein, 9 aa, Homo Sapiens
AGASGARHG

SEQ ID NO: 1385097 - protein, 9 aa, Homo Sapiens
LEPGEAALW

SEQ ID NO: 1385098 - protein, 9 aa, Homo Sapiens
SFQMHIKVT

SEQ ID NO: 1385099 - protein, 9 aa, Homo Sapiens
QRLDFYQHN

SEQ ID NO: 1385100 - protein, 9 aa, Homo Sapiens
HHPERIHLH

SEQ ID NO: 1385101 - protein, 9 aa, Homo Sapiens
DIFLMKRFL

SEQ ID NO: 1385102 - protein, 9 aa, Homo Sapiens
LGLLILLGI

SEQ ID NO: 1385103 - protein, 9 aa, Homo Sapiens
KNLVACPDL

SEQ ID NO: 1385104 - protein, 9 aa, Homo Sapiens
PDFVPEKWR

SEQ ID NO: 1385105 - protein, 9 aa, Homo Sapiens
LMSFEDFLL

SEQ ID NO: 1385106 - protein, 9 aa, Homo Sapiens
PAAQDGARC

SEQ ID NO: 1385107 - protein, 9 aa, Homo Sapiens
WPSSIPNLK

SEQ ID NO: 1385108 - protein, 9 aa, Homo Sapiens
LPMRSLGEP

SEQ ID NO: 1385109 - protein, 9 aa, Homo Sapiens
SPCRWLKMC

SEQ ID NO: 1385110 - protein, 9 aa, Homo Sapiens
QKFTHFYLD

SEQ ID NO: 1385111 - protein, 9 aa, Homo Sapiens
NDLSSTLER

SEQ ID NO: 1385112 - protein, 9 aa, Homo Sapiens
GPTPSSPAA

SEQ ID NO: 1385113 - protein, 9 aa, Homo Sapiens
LGFTPADTV

SEQ ID NO: 1385114 - protein, 9 aa, Homo Sapiens
RRGTGVNLG

SEQ ID NO: 1385115 - protein, 9 aa, Homo Sapiens
PLGDTPQPS

SEQ ID NO: 1385116 - protein, 9 aa, Homo Sapiens
MAEKPKHHY

SEQ ID NO: 1385117 - protein, 9 aa, Homo Sapiens
SCNVFLGGV

SEQ ID NO: 1385118 - protein, 9 aa, Homo Sapiens
GIEIHVSVE

SEQ ID NO: 1385119 - protein, 9 aa, Homo Sapiens
VNAKKMVTS

SEQ ID NO: 1385120 - protein, 9 aa, Homo Sapiens
KRPQRKGVC

SEQ ID NO: 1385121 - protein, 9 aa, Homo Sapiens
GPSEGVIAV

SEQ ID NO: 1385122 - protein, 9 aa, Homo Sapiens
PHVCQDIPA

SEQ ID NO: 1385123 - protein, 9 aa, Homo Sapiens
PGVPGSPGM

SEQ ID NO: 1385124 - protein, 9 aa, Homo Sapiens
EKASKRPWS

SEQ ID NO: 1385125 - protein, 9 aa, Homo Sapiens
KLRRAALKS

SEQ ID NO: 1385126 - protein, 9 aa, Homo Sapiens
PGRPGLQGP

SEQ ID NO: 1385127 - protein, 9 aa, Homo Sapiens
VITRGMKMY

SEQ ID NO: 1385128 - protein, 9 aa, Homo Sapiens
EPYAFRDLN

SEQ ID NO: 1385129 - protein, 9 aa, Homo Sapiens
EGWMGPKCN

SEQ ID NO: 1385130 - protein, 9 aa, Homo Sapiens
QPTALFQLE

SEQ ID NO: 1385131 - protein, 9 aa, Homo Sapiens
LICFHVRFD

SEQ ID NO: 1385132 - protein, 9 aa, Homo Sapiens
VGAAGQERR

SEQ ID NO: 1385133 - protein, 9 aa, Homo Sapiens
SSQSLTPAT

SEQ ID NO: 1385134 - protein, 9 aa, Homo Sapiens
PEVGRLGGV

SEQ ID NO: 1385135 - protein, 9 aa, Homo Sapiens
EGSAEIPTG

SEQ ID NO: 1385136 - protein, 9 aa, Homo Sapiens
VIYVFMNQQ

SEQ ID NO: 1385137 - protein, 9 aa, Homo Sapiens
VVAQMDEDF

SEQ ID NO: 1385138 - protein, 9 aa, Homo Sapiens
RRVIVERIG

SEQ ID NO: 1385139 - protein, 9 aa, Homo Sapiens
SISGHVRVH

SEQ ID NO: 1385140 - protein, 9 aa, Homo Sapiens
SAVSAPQTE

SEQ ID NO: 1385141 - protein, 9 aa, Homo Sapiens
RPALGGVFL

SEQ ID NO: 1385142 - protein, 9 aa, Homo Sapiens
DSRSFFTSA

SEQ ID NO: 1385143 - protein, 9 aa, Homo Sapiens
SPKVTLGWG

SEQ ID NO: 1385144 - protein, 9 aa, Homo Sapiens
NAQVHQLLL

SEQ ID NO: 1385145 - protein, 9 aa, Homo Sapiens
SSSCSTPPC

SEQ ID NO: 1385146 - protein, 9 aa, Homo Sapiens
SWRRWGTLG

SEQ ID NO: 1385147 - protein, 9 aa, Homo Sapiens
PAVAFRLAS

SEQ ID NO: 1385148 - protein, 9 aa, Homo Sapiens
EAAQLSEDV

SEQ ID NO: 1385149 - protein, 9 aa, Homo Sapiens
FVASPGRRD

SEQ ID NO: 1385150 - protein, 9 aa, Homo Sapiens
GRLWRPTAI

SEQ ID NO: 1385151 - protein, 9 aa, Homo Sapiens
TTIFMAQKE

SEQ ID NO: 1385152 - protein, 9 aa, Homo Sapiens
VFNFFWVGG

SEQ ID NO: 1385153 - protein, 9 aa, Homo Sapiens
ETGLCGATF

SEQ ID NO: 1385154 - protein, 9 aa, Homo Sapiens
LQALAMWEK

SEQ ID NO: 1385155 - protein, 9 aa, Homo Sapiens
ILQRKKLSD

SEQ ID NO: 1385156 - protein, 9 aa, Homo Sapiens
LVAYEDGKL

SEQ ID NO: 1385157 - protein, 9 aa, Homo Sapiens
QFLHKLILD

SEQ ID NO: 1385158 - protein, 9 aa, Homo Sapiens
LVYIMSTTG

SEQ ID NO: 1385159 - protein, 9 aa, Homo Sapiens
QAHRLEHGD

SEQ ID NO: 1385160 - protein, 9 aa, Homo Sapiens
QGSIISTQV

SEQ ID NO: 1385161 - protein, 9 aa, Homo Sapiens
LILKRKGLR

SEQ ID NO: 1385162 - protein, 9 aa, Homo Sapiens
TPRSPTRCC

SEQ ID NO: 1385163 - protein, 9 aa, Homo Sapiens
FRRGTGVNL

SEQ ID NO: 1385164 - protein, 9 aa, Homo Sapiens
LSAIVSISA

SEQ ID NO: 1385165 - protein, 9 aa, Homo Sapiens
EEGPGLGAA

SEQ ID NO: 1385166 - protein, 9 aa, Homo Sapiens
KGKSPQPPE

SEQ ID NO: 1385167 - protein, 9 aa, Homo Sapiens
SAGEGPSRC

SEQ ID NO: 1385168 - protein, 9 aa, Homo Sapiens
TAATLRCPA

SEQ ID NO: 1385169 - protein, 9 aa, Homo Sapiens
ELIEFEKLS

SEQ ID NO: 1385170 - protein, 9 aa, Homo Sapiens
LHPEVRSKE

SEQ ID NO: 1385171 - protein, 9 aa, Homo Sapiens
KKLSDTPKG

SEQ ID NO: 1385172 - protein, 9 aa, Homo Sapiens
SPPRGRSQD

SEQ ID NO: 1385173 - protein, 9 aa, Homo Sapiens
VHHERKYAP

SEQ ID NO: 1385174 - protein, 9 aa, Homo Sapiens
LGAGAGGRS

SEQ ID NO: 1385175 - protein, 9 aa, Homo Sapiens
RLNNPPGVL

SEQ ID NO: 1385176 - protein, 9 aa, Homo Sapiens
WAWRSRASG

SEQ ID NO: 1385177 - protein, 9 aa, Homo Sapiens
CLEEFEGGG

SEQ ID NO: 1385178 - protein, 9 aa, Homo Sapiens
QLRKAITDH

SEQ ID NO: 1385179 - protein, 9 aa, Homo Sapiens
TTDRHFAGP

SEQ ID NO: 1385180 - protein, 9 aa, Homo Sapiens
GSPPLDSTK

SEQ ID NO: 1385181 - protein, 9 aa, Homo Sapiens
LTKKDIFGA

SEQ ID NO: 1385182 - protein, 9 aa, Homo Sapiens
STSTEEMEP

SEQ ID NO: 1385183 - protein, 9 aa, Homo Sapiens
LKEARHALS

SEQ ID NO: 1385184 - protein, 9 aa, Homo Sapiens
LCQCDKKRG

SEQ ID NO: 1385185 - protein, 9 aa, Homo Sapiens
NPLLSILQH

SEQ ID NO: 1385186 - protein, 9 aa, Homo Sapiens
PTPPSTQFH

SEQ ID NO: 1385187 - protein, 9 aa, Homo Sapiens
WTMGLRPWW

SEQ ID NO: 1385188 - protein, 9 aa, Homo Sapiens
VEPYAFRDL

SEQ ID NO: 1385189 - protein, 9 aa, Homo Sapiens
LAAGDYDVE

SEQ ID NO: 1385190 - protein, 9 aa, Homo Sapiens
QELPGKELN

SEQ ID NO: 1385191 - protein, 9 aa, Homo Sapiens
SCGICKNHD

SEQ ID NO: 1385192 - protein, 9 aa, Homo Sapiens
SPSSLLSPC

SEQ ID NO: 1385193 - protein, 9 aa, Homo Sapiens
GPGAWTLTM

SEQ ID NO: 1385194 - protein, 9 aa, Homo Sapiens
LHPDVAHLA

SEQ ID NO: 1385195 - protein, 9 aa, Homo Sapiens
SGMRDRSLS

SEQ ID NO: 1385196 - protein, 9 aa, Homo Sapiens
KSEEYLLCF

SEQ ID NO: 1385197 - protein, 9 aa, Homo Sapiens
LVIATGNRE

SEQ ID NO: 1385198 - protein, 9 aa, Homo Sapiens
KRERTATEE

SEQ ID NO: 1385199 - protein, 9 aa, Homo Sapiens
VIIKDIFLM

SEQ ID NO: 1385200 - protein, 9 aa, Homo Sapiens
TAETQDVQM

SEQ ID NO: 1385201 - protein, 9 aa, Homo Sapiens
SPQAHKLWM

SEQ ID NO: 1385202 - protein, 9 aa, Homo Sapiens
YVRDTLQLG

SEQ ID NO: 1385203 - protein, 9 aa, Homo Sapiens
VPRKKEEDW

SEQ ID NO: 1385204 - protein, 9 aa, Homo Sapiens
MLRSIMSGD

SEQ ID NO: 1385205 - protein, 9 aa, Homo Sapiens
YLPKQPDLR

SEQ ID NO: 1385206 - protein, 9 aa, Homo Sapiens
LETGAPLPE

SEQ ID NO: 1385207 - protein, 9 aa, Homo Sapiens
GPKSRGPAA

SEQ ID NO: 1385208 - protein, 9 aa, Homo Sapiens
LAGSVGAGT

SEQ ID NO: 1385209 - protein, 9 aa, Homo Sapiens
EESGGVVDN

SEQ ID NO: 1385210 - protein, 9 aa, Homo Sapiens
KVFKRAMEG

SEQ ID NO: 1385211 - protein, 9 aa, Homo Sapiens
VCRENIVGD

SEQ ID NO: 1385212 - protein, 9 aa, Homo Sapiens
GGFWKLTPE

SEQ ID NO: 1385213 - protein, 9 aa, Homo Sapiens
VPAHCKVLM

SEQ ID NO: 1385214 - protein, 9 aa, Homo Sapiens
WGAWLAVSY

SEQ ID NO: 1385215 - protein, 9 aa, Homo Sapiens
RKKREKIIN

SEQ ID NO: 1385216 - protein, 9 aa, Homo Sapiens
GTDVGIVLK

SEQ ID NO: 1385217 - protein, 9 aa, Homo Sapiens
WLKMCPLWR

SEQ ID NO: 1385218 - protein, 9 aa, Homo Sapiens
SSLNRMPSV

SEQ ID NO: 1385219 - protein, 9 aa, Homo Sapiens
GRSQVSGGP

SEQ ID NO: 1385220 - protein, 9 aa, Homo Sapiens
HKEEEDDDD

SEQ ID NO: 1385221 - protein, 9 aa, Homo Sapiens
EVPKDNKSK

SEQ ID NO: 1385222 - protein, 9 aa, Homo Sapiens
ARGLKMKCV

SEQ ID NO: 1385223 - protein, 9 aa, Homo Sapiens
VVVEGVHGP

SEQ ID NO: 1385224 - protein, 9 aa, Homo Sapiens
HIYIHTHTF

SEQ ID NO: 1385225 - protein, 9 aa, Homo Sapiens
VVKKCHEKS

SEQ ID NO: 1385226 - protein, 9 aa, Homo Sapiens
LCLDERQIK

SEQ ID NO: 1385227 - protein, 9 aa, Homo Sapiens
QMVVMIQTF

SEQ ID NO: 1385228 - protein, 9 aa, Homo Sapiens
LCKNGQVWA

SEQ ID NO: 1385229 - protein, 9 aa, Homo Sapiens
KNSFEGQYK

SEQ ID NO: 1385230 - protein, 9 aa, Homo Sapiens
EALSFTKQN

SEQ ID NO: 1385231 - protein, 9 aa, Homo Sapiens
LGTDILLIV

SEQ ID NO: 1385232 - protein, 9 aa, Homo Sapiens
RAPTPRSPT

SEQ ID NO: 1385233 - protein, 9 aa, Homo Sapiens
RAGPAAALC

SEQ ID NO: 1385234 - protein, 9 aa, Homo Sapiens
SSTSRDSRS

SEQ ID NO: 1385235 - protein, 9 aa, Homo Sapiens
GIPGDRGLQ

SEQ ID NO: 1385236 - protein, 9 aa, Homo Sapiens
RLFRVEFSG

SEQ ID NO: 1385237 - protein, 9 aa, Homo Sapiens
WATKGRPRK

SEQ ID NO: 1385238 - protein, 9 aa, Homo Sapiens
FDCFVAICN

SEQ ID NO: 1385239 - protein, 9 aa, Homo Sapiens
FMNSGFGKI

SEQ ID NO: 1385240 - protein, 9 aa, Homo Sapiens
WLPMRSLGE

SEQ ID NO: 1385241 - protein, 9 aa, Homo Sapiens
MFFSQSLIC

SEQ ID NO: 1385242 - protein, 9 aa, Homo Sapiens
LLLSRDVPQ

SEQ ID NO: 1385243 - protein, 9 aa, Homo Sapiens
GRWTTRPCR

SEQ ID NO: 1385244 - protein, 9 aa, Homo Sapiens
EVIRCCQQK

SEQ ID NO: 1385245 - protein, 9 aa, Homo Sapiens
VQTPVLFGY

SEQ ID NO: 1385246 - protein, 9 aa, Homo Sapiens
GVARSEGKG

SEQ ID NO: 1385247 - protein, 9 aa, Homo Sapiens
TGWLERAYG

SEQ ID NO: 1385248 - protein, 9 aa, Homo Sapiens
HASTHDNLP

SEQ ID NO: 1385249 - protein, 9 aa, Homo Sapiens
NEDGEELAT

SEQ ID NO: 1385250 - protein, 9 aa, Homo Sapiens
VFNFETFGN

SEQ ID NO: 1385251 - protein, 9 aa, Homo Sapiens
CSHPRLDHQ

SEQ ID NO: 1385252 - protein, 9 aa, Homo Sapiens
PVNAFMVWS

SEQ ID NO: 1385253 - protein, 9 aa, Homo Sapiens
SMEVYAWAP

SEQ ID NO: 1385254 - protein, 9 aa, Homo Sapiens
YMLSEEIIG

SEQ ID NO: 1385255 - protein, 9 aa, Homo Sapiens
KPQKNVKVK

SEQ ID NO: 1385256 - protein, 9 aa, Homo Sapiens
VVLQNLFPS

SEQ ID NO: 1385257 - protein, 9 aa, Homo Sapiens
SGKWGSSKS

SEQ ID NO: 1385258 - protein, 9 aa, Homo Sapiens
MATSQVTSS

SEQ ID NO: 1385259 - protein, 9 aa, Homo Sapiens
LPSLRTISS

SEQ ID NO: 1385260 - protein, 9 aa, Homo Sapiens
VKQDSDSKH

SEQ ID NO: 1385261 - protein, 9 aa, Homo Sapiens
IMGYDRYVA

SEQ ID NO: 1385262 - protein, 9 aa, Homo Sapiens
SEHPTLQAI

SEQ ID NO: 1385263 - protein, 9 aa, Homo Sapiens
SQVSGGPPT

SEQ ID NO: 1385264 - protein, 9 aa, Homo Sapiens
LLVGRLMNR

SEQ ID NO: 1385265 - protein, 9 aa, Homo Sapiens
NIQDKHLVD

SEQ ID NO: 1385266 - protein, 9 aa, Homo Sapiens
EKQGDTIEC

SEQ ID NO: 1385267 - protein, 9 aa, Homo Sapiens
EAEEGSWSW

SEQ ID NO: 1385268 - protein, 9 aa, Homo Sapiens
MSLACSITV

SEQ ID NO: 1385269 - protein, 9 aa, Homo Sapiens
AKDGRLAGR

SEQ ID NO: 1385270 - protein, 9 aa, Homo Sapiens
FGKSDELIG

SEQ ID NO: 1385271 - protein, 9 aa, Homo Sapiens
GGKFAPFFV

SEQ ID NO: 1385272 - protein, 9 aa, Homo Sapiens
ETEIEVSIS

SEQ ID NO: 1385273 - protein, 9 aa, Homo Sapiens
SCVIRTPQG

SEQ ID NO: 1385274 - protein, 9 aa, Homo Sapiens
VVDNNHCQM

SEQ ID NO: 1385275 - protein, 9 aa, Homo Sapiens
VHQLLLSRL

SEQ ID NO: 1385276 - protein, 9 aa, Homo Sapiens
LPKKICVRS

SEQ ID NO: 1385277 - protein, 9 aa, Homo Sapiens
QPWVLRVTD

SEQ ID NO: 1385278 - protein, 9 aa, Homo Sapiens
PSLVCVTTI

SEQ ID NO: 1385279 - protein, 9 aa, Homo Sapiens
MQPVQFSQQ

SEQ ID NO: 1385280 - protein, 9 aa, Homo Sapiens
GSSLCSTSL

SEQ ID NO: 1385281 - protein, 9 aa, Homo Sapiens
EDSPPRGRS

SEQ ID NO: 1385282 - protein, 9 aa, Homo Sapiens
KYLNCIRIF

SEQ ID NO: 1385283 - protein, 9 aa, Homo Sapiens
LMPQSFFFF

SEQ ID NO: 1385284 - protein, 9 aa, Homo Sapiens
WEFMVFADA

SEQ ID NO: 1385285 - protein, 9 aa, Homo Sapiens
LLILRFCFK

SEQ ID NO: 1385286 - protein, 9 aa, Homo Sapiens
WLWMSSGSL

SEQ ID NO: 1385287 - protein, 9 aa, Homo Sapiens
EPADQKTAI

SEQ ID NO: 1385288 - protein, 9 aa, Homo Sapiens
NEPLSFLQC

SEQ ID NO: 1385289 - protein, 9 aa, Homo Sapiens
VEGVHGPGP

SEQ ID NO: 1385290 - protein, 9 aa, Homo Sapiens
SAHPSRPCR

SEQ ID NO: 1385291 - protein, 9 aa, Homo Sapiens
VAGGDLAAT

SEQ ID NO: 1385292 - protein, 9 aa, Homo Sapiens
VAVPKGEAG

SEQ ID NO: 1385293 - protein, 9 aa, Homo Sapiens
LVGAPCFLR

SEQ ID NO: 1385294 - protein, 9 aa, Homo Sapiens
MTSHMNSVK

SEQ ID NO: 1385295 - protein, 9 aa, Homo Sapiens
KVKEQKGKR

SEQ ID NO: 1385296 - protein, 9 aa, Homo Sapiens
SIFLIPSLS

SEQ ID NO: 1385297 - protein, 9 aa, Homo Sapiens
STQFHSLRR

SEQ ID NO: 1385298 - protein, 9 aa, Homo Sapiens
SRRMSVRIV

SEQ ID NO: 1385299 - protein, 9 aa, Homo Sapiens
KPAGHFTQD

SEQ ID NO: 1385300 - protein, 9 aa, Homo Sapiens
LHKADMLEK

SEQ ID NO: 1385301 - protein, 9 aa, Homo Sapiens
PEKWRKCPK

SEQ ID NO: 1385302 - protein, 9 aa, Homo Sapiens
ITIWVYVYV

SEQ ID NO: 1385303 - protein, 9 aa, Homo Sapiens
LPGQPPSPA

SEQ ID NO: 1385304 - protein, 9 aa, Homo Sapiens
IYLLVRHMY

SEQ ID NO: 1385305 - protein, 9 aa, Homo Sapiens
IYIYTHIYI

SEQ ID NO: 1385306 - protein, 9 aa, Homo Sapiens
SDLPSGRRT

SEQ ID NO: 1385307 - protein, 9 aa, Homo Sapiens
CAVELKSEE

SEQ ID NO: 1385308 - protein, 9 aa, Homo Sapiens
WLFKHHRAR

SEQ ID NO: 1385309 - protein, 9 aa, Homo Sapiens
MSTTGWLER

SEQ ID NO: 1385310 - protein, 9 aa, Homo Sapiens
HHCSSRKQS

SEQ ID NO: 1385311 - protein, 9 aa, Homo Sapiens
LKFLCLKKG

SEQ ID NO: 1385312 - protein, 9 aa, Homo Sapiens
VKGVQSATV

SEQ ID NO: 1385313 - protein, 9 aa, Homo Sapiens
QLHHGSQYE

SEQ ID NO: 1385314 - protein, 9 aa, Homo Sapiens
LVLSLPRVP

SEQ ID NO: 1385315 - protein, 9 aa, Homo Sapiens
RTRTCPSPP

SEQ ID NO: 1385316 - protein, 9 aa, Homo Sapiens
TNTSATREP

SEQ ID NO: 1385317 - protein, 9 aa, Homo Sapiens
EPGEAALWC

SEQ ID NO: 1385318 - protein, 9 aa, Homo Sapiens
FYLHISQAM

SEQ ID NO: 1385319 - protein, 9 aa, Homo Sapiens
RVLDRQGWG

SEQ ID NO: 1385320 - protein, 9 aa, Homo Sapiens
PACAQWSPV

SEQ ID NO: 1385321 - protein, 9 aa, Homo Sapiens
YIRRHPGGD

SEQ ID NO: 1385322 - protein, 9 aa, Homo Sapiens
TSGPATMSP

SEQ ID NO: 1385323 - protein, 9 aa, Homo Sapiens
SQSLTPATP

SEQ ID NO: 1385324 - protein, 9 aa, Homo Sapiens
KERQTEKCV

SEQ ID NO: 1385325 - protein, 9 aa, Homo Sapiens
IQRCIADSQ

SEQ ID NO: 1385326 - protein, 9 aa, Homo Sapiens
ERLTIRKEE

SEQ ID NO: 1385327 - protein, 9 aa, Homo Sapiens
RMGGRHPSW

SEQ ID NO: 1385328 - protein, 9 aa, Homo Sapiens
LQLAEPLWK

SEQ ID NO: 1385329 - protein, 9 aa, Homo Sapiens
QIFDNMKLP

SEQ ID NO: 1385330 - protein, 9 aa, Homo Sapiens
QCIQEALHE

SEQ ID NO: 1385331 - protein, 9 aa, Homo Sapiens
LRFKVLLML

SEQ ID NO: 1385332 - protein, 9 aa, Homo Sapiens
RSTGLTGEQ

SEQ ID NO: 1385333 - protein, 9 aa, Homo Sapiens
DAHVLPQAQ

SEQ ID NO: 1385334 - protein, 9 aa, Homo Sapiens
EEMEPSRSS

SEQ ID NO: 1385335 - protein, 9 aa, Homo Sapiens
GAGAGGRSG

SEQ ID NO: 1385336 - protein, 9 aa, Homo Sapiens
PALGGVFLA

SEQ ID NO: 1385337 - protein, 9 aa, Homo Sapiens
GRMGGRHPS

SEQ ID NO: 1385338 - protein, 9 aa, Homo Sapiens
WSASSPSWA

SEQ ID NO: 1385339 - protein, 9 aa, Homo Sapiens
LWELVTWEV

SEQ ID NO: 1385340 - protein, 9 aa, Homo Sapiens
GEESGGVVD

SEQ ID NO: 1385341 - protein, 9 aa, Homo Sapiens
GIDLTKKDI

SEQ ID NO: 1385342 - protein, 9 aa, Homo Sapiens
NRGDAAGPR

SEQ ID NO: 1385343 - protein, 9 aa, Homo Sapiens
FGELPLLLA

SEQ ID NO: 1385344 - protein, 9 aa, Homo Sapiens
TEVIRNVAK

SEQ ID NO: 1385345 - protein, 9 aa, Homo Sapiens
DDRHWSMQN

SEQ ID NO: 1385346 - protein, 9 aa, Homo Sapiens
AWLAVSYAG

SEQ ID NO: 1385347 - protein, 9 aa, Homo Sapiens
LPRRLGAGA

SEQ ID NO: 1385348 - protein, 9 aa, Homo Sapiens
LWLSWRRSG

SEQ ID NO: 1385349 - protein, 9 aa, Homo Sapiens
GWVEEWYND

SEQ ID NO: 1385350 - protein, 9 aa, Homo Sapiens
GGNRSICLT

SEQ ID NO: 1385351 - protein, 9 aa, Homo Sapiens
RGSCSSWRR

SEQ ID NO: 1385352 - protein, 9 aa, Homo Sapiens
VVITRGMKM

SEQ ID NO: 1385353 - protein, 9 aa, Homo Sapiens
NDSVEHRDN

SEQ ID NO: 1385354 - protein, 9 aa, Homo Sapiens
RQHPPPAKH

SEQ ID NO: 1385355 - protein, 9 aa, Homo Sapiens
KNSREDKRE

SEQ ID NO: 1385356 - protein, 9 aa, Homo Sapiens
AFRDLNYLR

SEQ ID NO: 1385357 - protein, 9 aa, Homo Sapiens
SWNLSQVGV

SEQ ID NO: 1385358 - protein, 9 aa, Homo Sapiens
AAISMMYIT

SEQ ID NO: 1385359 - protein, 9 aa, Homo Sapiens
ICKNHDQHL

SEQ ID NO: 1385360 - protein, 9 aa, Homo Sapiens
LLVSQVIIA

SEQ ID NO: 1385361 - protein, 9 aa, Homo Sapiens
TYVKLDRLG

SEQ ID NO: 1385362 - protein, 9 aa, Homo Sapiens
MFIGTDVGI

SEQ ID NO: 1385363 - protein, 9 aa, Homo Sapiens
LVTGQNSTD

SEQ ID NO: 1385364 - protein, 9 aa, Homo Sapiens
SLACSITVS

SEQ ID NO: 1385365 - protein, 9 aa, Homo Sapiens
GWPTSSCCS

SEQ ID NO: 1385366 - protein, 9 aa, Homo Sapiens
QPPSPARAA

SEQ ID NO: 1385367 - protein, 9 aa, Homo Sapiens
YRRSQQLHH

SEQ ID NO: 1385368 - protein, 9 aa, Homo Sapiens
IFMAQKEMK

SEQ ID NO: 1385369 - protein, 9 aa, Homo Sapiens
STGSSREVG

SEQ ID NO: 1385370 - protein, 9 aa, Homo Sapiens
MVPTGDQDR

SEQ ID NO: 1385371 - protein, 9 aa, Homo Sapiens
IQPCIQIIE

SEQ ID NO: 1385372 - protein, 9 aa, Homo Sapiens
TGRQHPPPA

SEQ ID NO: 1385373 - protein, 9 aa, Homo Sapiens
YDQEPDGDY

SEQ ID NO: 1385374 - protein, 9 aa, Homo Sapiens
DKRERTATE

SEQ ID NO: 1385375 - protein, 9 aa, Homo Sapiens
VISWIRQVV

SEQ ID NO: 1385376 - protein, 9 aa, Homo Sapiens
EEEDDEEAQ

SEQ ID NO: 1385377 - protein, 9 aa, Homo Sapiens
VEFSGESKE

SEQ ID NO: 1385378 - protein, 9 aa, Homo Sapiens
QALAMWEKG

SEQ ID NO: 1385379 - protein, 9 aa, Homo Sapiens
TKKPLYENL

SEQ ID NO: 1385380 - protein, 9 aa, Homo Sapiens
QLFEKNRSL

SEQ ID NO: 1385381 - protein, 9 aa, Homo Sapiens
IHWTCGLGS

SEQ ID NO: 1385382 - protein, 9 aa, Homo Sapiens
AKRGSSPSP

SEQ ID NO: 1385383 - protein, 9 aa, Homo Sapiens
PRFWACGRG

SEQ ID NO: 1385384 - protein, 9 aa, Homo Sapiens
ASIHTSCCH

SEQ ID NO: 1385385 - protein, 9 aa, Homo Sapiens
GGLRANTVL

SEQ ID NO: 1385386 - protein, 9 aa, Homo Sapiens
RHWSMQNFS

SEQ ID NO: 1385387 - protein, 9 aa, Homo Sapiens
TRPCRRSSS

SEQ ID NO: 1385388 - protein, 9 aa, Homo Sapiens
TPDQDCDKI

SEQ ID NO: 1385389 - protein, 9 aa, Homo Sapiens
GSEADGLDS

SEQ ID NO: 1385390 - protein, 9 aa, Homo Sapiens
CVPVPRKKE

SEQ ID NO: 1385391 - protein, 9 aa, Homo Sapiens
CGSQPWDIN

SEQ ID NO: 1385392 - protein, 9 aa, Homo Sapiens
KMKCVGHEE

SEQ ID NO: 1385393 - protein, 9 aa, Homo Sapiens
SVGATGRRQ

SEQ ID NO: 1385394 - protein, 9 aa, Homo Sapiens
GGDEQVAMR

SEQ ID NO: 1385395 - protein, 9 aa, Homo Sapiens
PSQVWTAAT

SEQ ID NO: 1385396 - protein, 9 aa, Homo Sapiens
DHPRAQCVV

SEQ ID NO: 1385397 - protein, 9 aa, Homo Sapiens
SLWGGPCGF

SEQ ID NO: 1385398 - protein, 9 aa, Homo Sapiens
PPHPEIQLC

SEQ ID NO: 1385399 - protein, 9 aa, Homo Sapiens
SRPCRMRLY

SEQ ID NO: 1385400 - protein, 9 aa, Homo Sapiens
SAYQTEGTW

SEQ ID NO: 1385401 - protein, 9 aa, Homo Sapiens
VSLWGWSLW

SEQ ID NO: 1385402 - protein, 9 aa, Homo Sapiens
GGVVDNNHC

SEQ ID NO: 1385403 - protein, 9 aa, Homo Sapiens
KSSMEVYAW

SEQ ID NO: 1385404 - protein, 9 aa, Homo Sapiens
RSLQHFTTG

SEQ ID NO: 1385405 - protein, 9 aa, Homo Sapiens
TRPSALDRC

SEQ ID NO: 1385406 - protein, 9 aa, Homo Sapiens
RGLTSRILD

SEQ ID NO: 1385407 - protein, 9 aa, Homo Sapiens
SLWLSWRRS

SEQ ID NO: 1385408 - protein, 9 aa, Homo Sapiens
SLWLSWRRW

SEQ ID NO: 1385409 - protein, 9 aa, Homo Sapiens
CLLAPPQCP

SEQ ID NO: 1385410 - protein, 9 aa, Homo Sapiens
ANCDWKPQW

SEQ ID NO: 1385411 - protein, 9 aa, Homo Sapiens
GAGVHGTSH

SEQ ID NO: 1385412 - protein, 9 aa, Homo Sapiens
ELVTWEVPF

SEQ ID NO: 1385413 - protein, 9 aa, Homo Sapiens
DALRKIQEN

SEQ ID NO: 1385414 - protein, 9 aa, Homo Sapiens
DAREDHSRL

SEQ ID NO: 1385415 - protein, 9 aa, Homo Sapiens
SPKSQTLDA

SEQ ID NO: 1385416 - protein, 9 aa, Homo Sapiens
AGPTPSSPA

SEQ ID NO: 1385417 - protein, 9 aa, Homo Sapiens
GSPIWHVQQ

SEQ ID NO: 1385418 - protein, 9 aa, Homo Sapiens
LQSLLSLYS

SEQ ID NO: 1385419 - protein, 9 aa, Homo Sapiens
LTTKKCLGH

SEQ ID NO: 1385420 - protein, 9 aa, Homo Sapiens
AANRTPTLR

SEQ ID NO: 1385421 - protein, 9 aa, Homo Sapiens
ARSWPTAAP

SEQ ID NO: 1385422 - protein, 9 aa, Homo Sapiens
RDGAGRYFL

SEQ ID NO: 1385423 - protein, 9 aa, Homo Sapiens
PMWPERIHQ

SEQ ID NO: 1385424 - protein, 9 aa, Homo Sapiens
KCAKITSVV

SEQ ID NO: 1385425 - protein, 9 aa, Homo Sapiens
IIAMYMKGG

SEQ ID NO: 1385426 - protein, 9 aa, Homo Sapiens
CMLKKTSFI

SEQ ID NO: 1385427 - protein, 9 aa, Homo Sapiens
IPMMPASQT

SEQ ID NO: 1385428 - protein, 9 aa, Homo Sapiens
NFITNPLSY

SEQ ID NO: 1385429 - protein, 9 aa, Homo Sapiens
TPKETPIEW

SEQ ID NO: 1385430 - protein, 9 aa, Homo Sapiens
GIFKVTRHW

SEQ ID NO: 1385431 - protein, 9 aa, Homo Sapiens
YEDPYWKED

SEQ ID NO: 1385432 - protein, 9 aa, Homo Sapiens
SGQGSIIST

SEQ ID NO: 1385433 - protein, 9 aa, Homo Sapiens
RCQRKAQRP

SEQ ID NO: 1385434 - protein, 9 aa, Homo Sapiens
KELRESIKR

SEQ ID NO: 1385435 - protein, 9 aa, Homo Sapiens
HQATYTECC

SEQ ID NO: 1385436 - protein, 9 aa, Homo Sapiens
EHKLLPLYF

SEQ ID NO: 1385437 - protein, 9 aa, Homo Sapiens
GAGVSPLCH

SEQ ID NO: 1385438 - protein, 9 aa, Homo Sapiens
SRSLQNLYL

SEQ ID NO: 1385439 - protein, 9 aa, Homo Sapiens
RGTTDRHFA

SEQ ID NO: 1385440 - protein, 9 aa, Homo Sapiens
LNCGEGTTV

SEQ ID NO: 1385441 - protein, 9 aa, Homo Sapiens
TEIEVSISE

SEQ ID NO: 1385442 - protein, 9 aa, Homo Sapiens
KYSGTHHVV

SEQ ID NO: 1385443 - protein, 9 aa, Homo Sapiens
NAFILLPCE

SEQ ID NO: 1385444 - protein, 9 aa, Homo Sapiens
TIHWTCGLG

SEQ ID NO: 1385445 - protein, 9 aa, Homo Sapiens
GGIIGGFWL

SEQ ID NO: 1385446 - protein, 9 aa, Homo Sapiens
EASTWAPVT

SEQ ID NO: 1385447 - protein, 9 aa, Homo Sapiens
MNSVKDVVC

SEQ ID NO: 1385448 - protein, 9 aa, Homo Sapiens
WNRGSCSSW

SEQ ID NO: 1385449 - protein, 9 aa, Homo Sapiens
RIVFQIFDN

SEQ ID NO: 1385450 - protein, 9 aa, Homo Sapiens
QDCDKIKQF

SEQ ID NO: 1385451 - protein, 9 aa, Homo Sapiens
RLLGIFKVT

SEQ ID NO: 1385452 - protein, 9 aa, Homo Sapiens
MKPAGHFTQ

SEQ ID NO: 1385453 - protein, 9 aa, Homo Sapiens
SSAVSSLKK

SEQ ID NO: 1385454 - protein, 9 aa, Homo Sapiens
GVVPPSTQV

SEQ ID NO: 1385455 - protein, 9 aa, Homo Sapiens
SSRADGLLC

SEQ ID NO: 1385456 - protein, 9 aa, Homo Sapiens
VIDINDHYP

SEQ ID NO: 1385457 - protein, 9 aa, Homo Sapiens
SSSNSSSDS

SEQ ID NO: 1385458 - protein, 9 aa, Homo Sapiens
ITVLAVVQK

SEQ ID NO: 1385459 - protein, 9 aa, Homo Sapiens
TKFHEMVTF

SEQ ID NO: 1385460 - protein, 9 aa, Homo Sapiens
QSECQKTVP

SEQ ID NO: 1385461 - protein, 9 aa, Homo Sapiens
ASSSGGRTA

SEQ ID NO: 1385462 - protein, 9 aa, Homo Sapiens
AVAFRLAST

SEQ ID NO: 1385463 - protein, 9 aa, Homo Sapiens
EAMLRYLET

SEQ ID NO: 1385464 - protein, 9 aa, Homo Sapiens
RNLFAFTPI

SEQ ID NO: 1385465 - protein, 9 aa, Homo Sapiens
HHKRMHSSE

SEQ ID NO: 1385466 - protein, 9 aa, Homo Sapiens
NNSPPCTSA

SEQ ID NO: 1385467 - protein, 9 aa, Homo Sapiens
SLLSILKLQ

SEQ ID NO: 1385468 - protein, 9 aa, Homo Sapiens
IEWEIRLAQ

SEQ ID NO: 1385469 - protein, 9 aa, Homo Sapiens
YGRLWRPTA

SEQ ID NO: 1385470 - protein, 9 aa, Homo Sapiens
TMSPWYRGP

SEQ ID NO: 1385471 - protein, 9 aa, Homo Sapiens
LDSTKSFAI

SEQ ID NO: 1385472 - protein, 9 aa, Homo Sapiens
YVACSCSHR

SEQ ID NO: 1385473 - protein, 9 aa, Homo Sapiens
TDFPSCVNC

SEQ ID NO: 1385474 - protein, 9 aa, Homo Sapiens
LDHQATYTE

SEQ ID NO: 1385475 - protein, 9 aa, Homo Sapiens
PPPPPTKKR

SEQ ID NO: 1385476 - protein, 9 aa, Homo Sapiens
VLQRVLYRH

SEQ ID NO: 1385477 - protein, 9 aa, Homo Sapiens
STTNKLTFS

SEQ ID NO: 1385478 - protein, 9 aa, Homo Sapiens
LHPPSSPPP

SEQ ID NO: 1385479 - protein, 9 aa, Homo Sapiens
YIHQGKEAT

SEQ ID NO: 1385480 - protein, 9 aa, Homo Sapiens
LQHLFLNSN

SEQ ID NO: 1385481 - protein, 9 aa, Homo Sapiens
FDRNPHFQN

SEQ ID NO: 1385482 - protein, 9 aa, Homo Sapiens
ARGPPSRGP

SEQ ID NO: 1385483 - protein, 9 aa, Homo Sapiens
QREEMVKNV

SEQ ID NO: 1385484 - protein, 9 aa, Homo Sapiens
GGLRHALSH

SEQ ID NO: 1385485 - protein, 9 aa, Homo Sapiens
PANMFITAT

SEQ ID NO: 1385486 - protein, 9 aa, Homo Sapiens
ALMSPRALL

SEQ ID NO: 1385487 - protein, 9 aa, Homo Sapiens
CLTSSMKSC

SEQ ID NO: 1385488 - protein, 9 aa, Homo Sapiens
QMQLQALAM

SEQ ID NO: 1385489 - protein, 9 aa, Homo Sapiens
RGKNFRKEK

SEQ ID NO: 1385490 - protein, 9 aa, Homo Sapiens
FLRGLWCSA

SEQ ID NO: 1385491 - protein, 9 aa, Homo Sapiens
LPWRGVGET

SEQ ID NO: 1385492 - protein, 9 aa, Homo Sapiens
CDMSVLQRV

SEQ ID NO: 1385493 - protein, 9 aa, Homo Sapiens
REKASKRPW

SEQ ID NO: 1385494 - protein, 9 aa, Homo Sapiens
CFFSVELMD

SEQ ID NO: 1385495 - protein, 9 aa, Homo Sapiens
QQYKLGVRL

SEQ ID NO: 1385496 - protein, 9 aa, Homo Sapiens
QHAAGKDVP

SEQ ID NO: 1385497 - protein, 9 aa, Homo Sapiens
VAVIEAKKR

SEQ ID NO: 1385498 - protein, 9 aa, Homo Sapiens
TPGCIRVRT

SEQ ID NO: 1385499 - protein, 9 aa, Homo Sapiens
HTSDAGTYP

SEQ ID NO: 1385500 - protein, 9 aa, Homo Sapiens
TYSPTSPKA

SEQ ID NO: 1385501 - protein, 9 aa, Homo Sapiens
DATGQQDGA

SEQ ID NO: 1385502 - protein, 9 aa, Homo Sapiens
GRQHPPPAK

SEQ ID NO: 1385503 - protein, 9 aa, Homo Sapiens
PLVTRPPAP

SEQ ID NO: 1385504 - protein, 9 aa, Homo Sapiens
TTASVVITR

SEQ ID NO: 1385505 - protein, 9 aa, Homo Sapiens
CVKKLYVLS

SEQ ID NO: 1385506 - protein, 9 aa, Homo Sapiens
LFFVLVNLE

SEQ ID NO: 1385507 - protein, 9 aa, Homo Sapiens
TGNRELLQD

SEQ ID NO: 1385508 - protein, 9 aa, Homo Sapiens
MTSWAIVCG

SEQ ID NO: 1385509 - protein, 9 aa, Homo Sapiens
PNYWIQAHR

SEQ ID NO: 1385510 - protein, 9 aa, Homo Sapiens
PSLYWEWPA

SEQ ID NO: 1385511 - protein, 9 aa, Homo Sapiens
VAGGHSGSE

SEQ ID NO: 1385512 - protein, 9 aa, Homo Sapiens
RAHQRTGRQ

SEQ ID NO: 1385513 - protein, 9 aa, Homo Sapiens
PISACPRLL

SEQ ID NO: 1385514 - protein, 9 aa, Homo Sapiens
EDIVCDGRL

SEQ ID NO: 1385515 - protein, 9 aa, Homo Sapiens
KRRISSSVL

SEQ ID NO: 1385516 - protein, 9 aa, Homo Sapiens
SPKRQKRQL

SEQ ID NO: 1385517 - protein, 9 aa, Homo Sapiens
VASSSGGRT

SEQ ID NO: 1385518 - protein, 9 aa, Homo Sapiens
RVAIRVLLG

SEQ ID NO: 1385519 - protein, 9 aa, Homo Sapiens
RTATEEKAR

SEQ ID NO: 1385520 - protein, 9 aa, Homo Sapiens
SCCGRAPSS

SEQ ID NO: 1385521 - protein, 9 aa, Homo Sapiens
FLLVFSAVV

SEQ ID NO: 1385522 - protein, 9 aa, Homo Sapiens
KAMTKKRVN

SEQ ID NO: 1385523 - protein, 9 aa, Homo Sapiens
SKTQIFICF

SEQ ID NO: 1385524 - protein, 9 aa, Homo Sapiens
DTFFNSPKS

SEQ ID NO: 1385525 - protein, 9 aa, Homo Sapiens
PPTCPRAYQ

SEQ ID NO: 1385526 - protein, 9 aa, Homo Sapiens
LMGVSVCPR

SEQ ID NO: 1385527 - protein, 9 aa, Homo Sapiens
FAVGIPQQC

SEQ ID NO: 1385528 - protein, 9 aa, Homo Sapiens
GGRSGRALP

SEQ ID NO: 1385529 - protein, 9 aa, Homo Sapiens
PGDFLVCGN

SEQ ID NO: 1385530 - protein, 9 aa, Homo Sapiens
LVLTASDDG

SEQ ID NO: 1385531 - protein, 9 aa, Homo Sapiens
CVTTIADIV

SEQ ID NO: 1385532 - protein, 9 aa, Homo Sapiens
NVINVQDYE

SEQ ID NO: 1385533 - protein, 9 aa, Homo Sapiens
CCSSWLRRI

SEQ ID NO: 1385534 - protein, 9 aa, Homo Sapiens
EILLLAVGF

SEQ ID NO: 1385535 - protein, 9 aa, Homo Sapiens
HSPHKGPPP

SEQ ID NO: 1385536 - protein, 9 aa, Homo Sapiens
VEAEAVMLG

SEQ ID NO: 1385537 - protein, 9 aa, Homo Sapiens
VLLTRTTAQ

SEQ ID NO: 1385538 - protein, 9 aa, Homo Sapiens
EGVIAVPTS

SEQ ID NO: 1385539 - protein, 9 aa, Homo Sapiens
DIGSEVSEG

SEQ ID NO: 1385540 - protein, 9 aa, Homo Sapiens
PRQPSYNIK

SEQ ID NO: 1385541 - protein, 9 aa, Homo Sapiens
DQICLKKGI

SEQ ID NO: 1385542 - protein, 9 aa, Homo Sapiens
HGRFRRDHA

SEQ ID NO: 1385543 - protein, 9 aa, Homo Sapiens
AALCSARAL

SEQ ID NO: 1385544 - protein, 9 aa, Homo Sapiens
LDIEVQIGG

SEQ ID NO: 1385545 - protein, 9 aa, Homo Sapiens
PGPCASLLS

SEQ ID NO: 1385546 - protein, 9 aa, Homo Sapiens
KTYEDPYWK

SEQ ID NO: 1385547 - protein, 9 aa, Homo Sapiens
SANLWGKFL

SEQ ID NO: 1385548 - protein, 9 aa, Homo Sapiens
LATGAMKVQ

SEQ ID NO: 1385549 - protein, 9 aa, Homo Sapiens
VHCKGRIHL

SEQ ID NO: 1385550 - protein, 9 aa, Homo Sapiens
ICFIEECSF

SEQ ID NO: 1385551 - protein, 9 aa, Homo Sapiens
TFKSRNSYL

SEQ ID NO: 1385552 - protein, 9 aa, Homo Sapiens
NHCDGVFDC

SEQ ID NO: 1385553 - protein, 9 aa, Homo Sapiens
LPPAVLGAG

SEQ ID NO: 1385554 - protein, 9 aa, Homo Sapiens
MGPKCNRAI

SEQ ID NO: 1385555 - protein, 9 aa, Homo Sapiens
KKGRYLRLS

SEQ ID NO: 1385556 - protein, 9 aa, Homo Sapiens
VECLEEFEG

SEQ ID NO: 1385557 - protein, 9 aa, Homo Sapiens
FLVTLITIW

SEQ ID NO: 1385558 - protein, 9 aa, Homo Sapiens
ISHSRRRRN

SEQ ID NO: 1385559 - protein, 9 aa, Homo Sapiens
TNSSVSSSP

SEQ ID NO: 1385560 - protein, 9 aa, Homo Sapiens
MHILSSCCK

SEQ ID NO: 1385561 - protein, 9 aa, Homo Sapiens
VGTWLTAWT

SEQ ID NO: 1385562 - protein, 9 aa, Homo Sapiens
VLYLKKKTR

SEQ ID NO: 1385563 - protein, 9 aa, Homo Sapiens
KSTWDLPRR

SEQ ID NO: 1385564 - protein, 9 aa, Homo Sapiens
IQQRQDNCQ

SEQ ID NO: 1385565 - protein, 9 aa, Homo Sapiens
VATQMQSFG

SEQ ID NO: 1385566 - protein, 9 aa, Homo Sapiens
IDLTKKDIF

SEQ ID NO: 1385567 - protein, 9 aa, Homo Sapiens
LRGPGPLEP

SEQ ID NO: 1385568 - protein, 9 aa, Homo Sapiens
IMCPLNPAA

SEQ ID NO: 1385569 - protein, 9 aa, Homo Sapiens
GQPTALFQL

SEQ ID NO: 1385570 - protein, 9 aa, Homo Sapiens
TWSVRITIH

SEQ ID NO: 1385571 - protein, 9 aa, Homo Sapiens
KSRNSYLAL

SEQ ID NO: 1385572 - protein, 9 aa, Homo Sapiens
GLKNIPGIR

SEQ ID NO: 1385573 - protein, 9 aa, Homo Sapiens
CEDVKAKPI

SEQ ID NO: 1385574 - protein, 9 aa, Homo Sapiens
EKHYLSAQR

SEQ ID NO: 1385575 - protein, 9 aa, Homo Sapiens
ENNSPPCTS

SEQ ID NO: 1385576 - protein, 9 aa, Homo Sapiens
SSPPPRPPW

SEQ ID NO: 1385577 - protein, 9 aa, Homo Sapiens
KKFLKILEG

SEQ ID NO: 1385578 - protein, 9 aa, Homo Sapiens
YSVKQDSDS

SEQ ID NO: 1385579 - protein, 9 aa, Homo Sapiens
TCLESGMSQ

SEQ ID NO: 1385580 - protein, 9 aa, Homo Sapiens
NVDAQPKKK

SEQ ID NO: 1385581 - protein, 9 aa, Homo Sapiens
RSSQCSSGS

SEQ ID NO: 1385582 - protein, 9 aa, Homo Sapiens
PVAEEAAAS

SEQ ID NO: 1385583 - protein, 9 aa, Homo Sapiens
FLVWPERGL

SEQ ID NO: 1385584 - protein, 9 aa, Homo Sapiens
SHKLFSFQM

SEQ ID NO: 1385585 - protein, 9 aa, Homo Sapiens
SCFPKNLVA

SEQ ID NO: 1385586 - protein, 9 aa, Homo Sapiens
FKMEEKMKT

SEQ ID NO: 1385587 - protein, 9 aa, Homo Sapiens
STTGWLERA

SEQ ID NO: 1385588 - protein, 9 aa, Homo Sapiens
NEAPPPSWT

SEQ ID NO: 1385589 - protein, 9 aa, Homo Sapiens
VRDTLQLGM

SEQ ID NO: 1385590 - protein, 9 aa, Homo Sapiens
GYKQEVAQL

SEQ ID NO: 1385591 - protein, 9 aa, Homo Sapiens
KSTKPQKNV

SEQ ID NO: 1385592 - protein, 9 aa, Homo Sapiens
ALSKLKKNI

SEQ ID NO: 1385593 - protein, 9 aa, Homo Sapiens
TRTSPAPWT

SEQ ID NO: 1385594 - protein, 9 aa, Homo Sapiens
PSRKAFRRF

SEQ ID NO: 1385595 - protein, 9 aa, Homo Sapiens
ALLTQPPTL

SEQ ID NO: 1385596 - protein, 9 aa, Homo Sapiens
SSTLERLTN

SEQ ID NO: 1385597 - protein, 9 aa, Homo Sapiens
SPAPWTQRT

SEQ ID NO: 1385598 - protein, 9 aa, Homo Sapiens
GMLMAGSVS

SEQ ID NO: 1385599 - protein, 9 aa, Homo Sapiens
KVLDQSDND

SEQ ID NO: 1385600 - protein, 9 aa, Homo Sapiens
FLNLLSPHT

SEQ ID NO: 1385601 - protein, 9 aa, Homo Sapiens
EDNTSAKLK

SEQ ID NO: 1385602 - protein, 9 aa, Homo Sapiens
VPEKWRKCP

SEQ ID NO: 1385603 - protein, 9 aa, Homo Sapiens
CTGKHPRRA

SEQ ID NO: 1385604 - protein, 9 aa, Homo Sapiens
GGCHPAWLS

SEQ ID NO: 1385605 - protein, 9 aa, Homo Sapiens
ILKHFRVLQ

SEQ ID NO: 1385606 - protein, 9 aa, Homo Sapiens
VLRVTDCTG

SEQ ID NO: 1385607 - protein, 9 aa, Homo Sapiens
LEVIRCCQQ

SEQ ID NO: 1385608 - protein, 9 aa, Homo Sapiens
FAVVKKCHE

SEQ ID NO: 1385609 - protein, 9 aa, Homo Sapiens
SETSSTGSS

SEQ ID NO: 1385610 - protein, 9 aa, Homo Sapiens
VVEGVHGPG

SEQ ID NO: 1385611 - protein, 9 aa, Homo Sapiens
VLDASAKKN

SEQ ID NO: 1385612 - protein, 9 aa, Homo Sapiens
LLSILKLQR

SEQ ID NO: 1385613 - protein, 9 aa, Homo Sapiens
FSTCASHFC

SEQ ID NO: 1385614 - protein, 9 aa, Homo Sapiens
PCNASIMCP

SEQ ID NO: 1385615 - protein, 9 aa, Homo Sapiens
CSMKKTIGC

SEQ ID NO: 1385616 - protein, 9 aa, Homo Sapiens
VMKLRRAAL

SEQ ID NO: 1385617 - protein, 9 aa, Homo Sapiens
HLPSAPAAA

SEQ ID NO: 1385618 - protein, 9 aa, Homo Sapiens
SDGATWTDI

SEQ ID NO: 1385619 - protein, 9 aa, Homo Sapiens
PLDMYECLR

SEQ ID NO: 1385620 - protein, 9 aa, Homo Sapiens
GGPCGFPGG

SEQ ID NO: 1385621 - protein, 9 aa, Homo Sapiens
LRVKALKKK

SEQ ID NO: 1385622 - protein, 9 aa, Homo Sapiens
LVFMKMEFR

SEQ ID NO: 1385623 - protein, 9 aa, Homo Sapiens
EDKRERTAT

SEQ ID NO: 1385624 - protein, 9 aa, Homo Sapiens
QNVRSKNFC

SEQ ID NO: 1385625 - protein, 9 aa, Homo Sapiens
VRDSEKMSR

SEQ ID NO: 1385626 - protein, 9 aa, Homo Sapiens
SHASCLCPL

SEQ ID NO: 1385627 - protein, 9 aa, Homo Sapiens
LCCALWGWF

SEQ ID NO: 1385628 - protein, 9 aa, Homo Sapiens
CLTAEILEL

SEQ ID NO: 1385629 - protein, 9 aa, Homo Sapiens
INSHTGRSG

SEQ ID NO: 1385630 - protein, 9 aa, Homo Sapiens
TRAPRRCQR

SEQ ID NO: 1385631 - protein, 9 aa, Homo Sapiens
KKCRVNAVE

SEQ ID NO: 1385632 - protein, 9 aa, Homo Sapiens
TPIEAYSSP

SEQ ID NO: 1385633 - protein, 9 aa, Homo Sapiens
NYVACSCSH

SEQ ID NO: 1385634 - protein, 9 aa, Homo Sapiens
LLHPPSSPP

SEQ ID NO: 1385635 - protein, 9 aa, Homo Sapiens
SLLVALPPV

SEQ ID NO: 1385636 - protein, 9 aa, Homo Sapiens
LNIENSERK

SEQ ID NO: 1385637 - protein, 9 aa, Homo Sapiens
GADGSITRD

SEQ ID NO: 1385638 - protein, 9 aa, Homo Sapiens
VSGSVSSTG

SEQ ID NO: 1385639 - protein, 9 aa, Homo Sapiens
DFPSCVNCV

SEQ ID NO: 1385640 - protein, 9 aa, Homo Sapiens
TPDSSAPHP

SEQ ID NO: 1385641 - protein, 9 aa, Homo Sapiens
LSTILILKF

SEQ ID NO: 1385642 - protein, 9 aa, Homo Sapiens
SKLNNKYLR

SEQ ID NO: 1385643 - protein, 9 aa, Homo Sapiens
DRETKEEYL

SEQ ID NO: 1385644 - protein, 9 aa, Homo Sapiens
PVGNLLVVF

SEQ ID NO: 1385645 - protein, 9 aa, Homo Sapiens
ITTQDHQPT

SEQ ID NO: 1385646 - protein, 9 aa, Homo Sapiens
FEDNTSAKL

SEQ ID NO: 1385647 - protein, 9 aa, Homo Sapiens
TLITIWVYV

SEQ ID NO: 1385648 - protein, 9 aa, Homo Sapiens
LGDAHVLPQ

SEQ ID NO: 1385649 - protein, 9 aa, Homo Sapiens
RAGPTPSSP

SEQ ID NO: 1385650 - protein, 9 aa, Homo Sapiens
QCPQASWNL

SEQ ID NO: 1385651 - protein, 9 aa, Homo Sapiens
KTIGCWEKL

SEQ ID NO: 1385652 - protein, 9 aa, Homo Sapiens
TRGMKMYVA

SEQ ID NO: 1385653 - protein, 9 aa, Homo Sapiens
RWEPFRKVV

SEQ ID NO: 1385654 - protein, 9 aa, Homo Sapiens
SPWNRGSCS

SEQ ID NO: 1385655 - protein, 9 aa, Homo Sapiens
CAEGEMRGV

SEQ ID NO: 1385656 - protein, 9 aa, Homo Sapiens
TTIADIVED

SEQ ID NO: 1385657 - protein, 9 aa, Homo Sapiens
DRYVTPWTL

SEQ ID NO: 1385658 - protein, 9 aa, Homo Sapiens
ASTTNKLTF

SEQ ID NO: 1385659 - protein, 9 aa, Homo Sapiens
RWTTRPCRR

SEQ ID NO: 1385660 - protein, 9 aa, Homo Sapiens
LFHCLNETQ

SEQ ID NO: 1385661 - protein, 9 aa, Homo Sapiens
VLSYIHIFS

SEQ ID NO: 1385662 - protein, 9 aa, Homo Sapiens
QRGLASVGA

SEQ ID NO: 1385663 - protein, 9 aa, Homo Sapiens
VDYLGLETQ

SEQ ID NO: 1385664 - protein, 9 aa, Homo Sapiens
VETAARGIK

SEQ ID NO: 1385665 - protein, 9 aa, Homo Sapiens
SACSIAMDA

SEQ ID NO: 1385666 - protein, 9 aa, Homo Sapiens
NRMPSVTEA

SEQ ID NO: 1385667 - protein, 9 aa, Homo Sapiens
DRGLTSRIL

SEQ ID NO: 1385668 - protein, 9 aa, Homo Sapiens
RECRTTEPV

SEQ ID NO: 1385669 - protein, 9 aa, Homo Sapiens
APPPSWTPA

SEQ ID NO: 1385670 - protein, 9 aa, Homo Sapiens
RKYAPRLAP

SEQ ID NO: 1385671 - protein, 9 aa, Homo Sapiens
ISCVIRTPQ

SEQ ID NO: 1385672 - protein, 9 aa, Homo Sapiens
GPGSGMEME

SEQ ID NO: 1385673 - protein, 9 aa, Homo Sapiens
APSQVWTAA

SEQ ID NO: 1385674 - protein, 9 aa, Homo Sapiens
MDLFSSCTL

SEQ ID NO: 1385675 - protein, 9 aa, Homo Sapiens
LFFLDKSFA

SEQ ID NO: 1385676 - protein, 9 aa, Homo Sapiens
SSAPSSMTL

SEQ ID NO: 1385677 - protein, 9 aa, Homo Sapiens
STTAATSSS

SEQ ID NO: 1385678 - protein, 9 aa, Homo Sapiens
ANRTPTLRE

SEQ ID NO: 1385679 - protein, 9 aa, Homo Sapiens
PAKHSSSQC

SEQ ID NO: 1385680 - protein, 9 aa, Homo Sapiens
VTLYGGRST

SEQ ID NO: 1385681 - protein, 9 aa, Homo Sapiens
LYGGRSTGL

SEQ ID NO: 1385682 - protein, 9 aa, Homo Sapiens
VFIQKNLCP

SEQ ID NO: 1385683 - protein, 9 aa, Homo Sapiens
KLQRGIYLI

SEQ ID NO: 1385684 - protein, 9 aa, Homo Sapiens
PSTQVEQLL

SEQ ID NO: 1385685 - protein, 9 aa, Homo Sapiens
PLLLAACTN

SEQ ID NO: 1385686 - protein, 9 aa, Homo Sapiens
AVTKIDAAS

SEQ ID NO: 1385687 - protein, 9 aa, Homo Sapiens
ALIAGSSLC

SEQ ID NO: 1385688 - protein, 9 aa, Homo Sapiens
LFLNSNGLE

SEQ ID NO: 1385689 - protein, 9 aa, Homo Sapiens
ECFESLRMR

SEQ ID NO: 1385690 - protein, 9 aa, Homo Sapiens
VTGQNSTDM

SEQ ID NO: 1385691 - protein, 9 aa, Homo Sapiens
YSDLFCSLK

SEQ ID NO: 1385692 - protein, 9 aa, Homo Sapiens
NFKVHFFVL

SEQ ID NO: 1385693 - protein, 9 aa, Homo Sapiens
YSPTSPKAQ

SEQ ID NO: 1385694 - protein, 9 aa, Homo Sapiens
SQTVTQSQP

SEQ ID NO: 1385695 - protein, 9 aa, Homo Sapiens
MDSKGDESK

SEQ ID NO: 1385696 - protein, 9 aa, Homo Sapiens
PRVPMNSLV

SEQ ID NO: 1385697 - protein, 9 aa, Homo Sapiens
MVKNVLENL

SEQ ID NO: 1385698 - protein, 9 aa, Homo Sapiens
KDNKSKICS

SEQ ID NO: 1385699 - protein, 9 aa, Homo Sapiens
MFARGLKMK

SEQ ID NO: 1385700 - protein, 9 aa, Homo Sapiens
AEIQKECLR

SEQ ID NO: 1385701 - protein, 9 aa, Homo Sapiens
RVGTWLTAW

SEQ ID NO: 1385702 - protein, 9 aa, Homo Sapiens
LWGKFLVSI

SEQ ID NO: 1385703 - protein, 9 aa, Homo Sapiens
TLASQFLSH

SEQ ID NO: 1385704 - protein, 9 aa, Homo Sapiens
VEHRDNLVV

SEQ ID NO: 1385705 - protein, 9 aa, Homo Sapiens
EFFMPELVD

SEQ ID NO: 1385706 - protein, 9 aa, Homo Sapiens
LSRSLQNLY

SEQ ID NO: 1385707 - protein, 9 aa, Homo Sapiens
RMVADEYLN

SEQ ID NO: 1385708 - protein, 9 aa, Homo Sapiens
VNFITNPLS

SEQ ID NO: 1385709 - protein, 9 aa, Homo Sapiens
LQAIACDAL

SEQ ID NO: 1385710 - protein, 9 aa, Homo Sapiens
PGIGSLLPW

SEQ ID NO: 1385711 - protein, 9 aa, Homo Sapiens
INPEENDTT

SEQ ID NO: 1385712 - protein, 9 aa, Homo Sapiens
RFLCFSSEG

SEQ ID NO: 1385713 - protein, 9 aa, Homo Sapiens
SAGYLCCAL

SEQ ID NO: 1385714 - protein, 9 aa, Homo Sapiens
SGSKPRGDE

SEQ ID NO: 1385715 - protein, 9 aa, Homo Sapiens
GVFQRLWDW

SEQ ID NO: 1385716 - protein, 9 aa, Homo Sapiens
TTQLKITVS

SEQ ID NO: 1385717 - protein, 9 aa, Homo Sapiens
VVVGTITED

SEQ ID NO: 1385718 - protein, 9 aa, Homo Sapiens
HKLLPLYFA

SEQ ID NO: 1385719 - protein, 9 aa, Homo Sapiens
TVSDVNDNA

SEQ ID NO: 1385720 - protein, 9 aa, Homo Sapiens
LECLTAEIL

SEQ ID NO: 1385721 - protein, 9 aa, Homo Sapiens
SKSTTEVIR

SEQ ID NO: 1385722 - protein, 9 aa, Homo Sapiens
DLLGLFFLD

SEQ ID NO: 1385723 - protein, 9 aa, Homo Sapiens
TASGCAFVV

SEQ ID NO: 1385724 - protein, 9 aa, Homo Sapiens
IYRCEDEHF

SEQ ID NO: 1385725 - protein, 9 aa, Homo Sapiens
SARSWPTAA

SEQ ID NO: 1385726 - protein, 9 aa, Homo Sapiens
LPLRSSGQP

SEQ ID NO: 1385727 - protein, 9 aa, Homo Sapiens
DKCIGVTNH

SEQ ID NO: 1385728 - protein, 9 aa, Homo Sapiens
MRGVFLFTD

SEQ ID NO: 1385729 - protein, 9 aa, Homo Sapiens
GVTNHCDGV

SEQ ID NO: 1385730 - protein, 9 aa, Homo Sapiens
AEFEDSGTE

SEQ ID NO: 1385731 - protein, 9 aa, Homo Sapiens
YSMVLQRLL

SEQ ID NO: 1385732 - protein, 9 aa, Homo Sapiens
KKQLFEKNR

SEQ ID NO: 1385733 - protein, 9 aa, Homo Sapiens
PGPGAWTLT

SEQ ID NO: 1385734 - protein, 9 aa, Homo Sapiens
HSKEVAVGQ

SEQ ID NO: 1385735 - protein, 9 aa, Homo Sapiens
KEAELCQVQ

SEQ ID NO: 1385736 - protein, 9 aa, Homo Sapiens
RLQSLLSLY

SEQ ID NO: 1385737 - protein, 9 aa, Homo Sapiens
WNNVGLLGA

SEQ ID NO: 1385738 - protein, 9 aa, Homo Sapiens
LANIWVGAQ

SEQ ID NO: 1385739 - protein, 9 aa, Homo Sapiens
SHKALSKEN

SEQ ID NO: 1385740 - protein, 9 aa, Homo Sapiens
DVYPEKILS

SEQ ID NO: 1385741 - protein, 9 aa, Homo Sapiens
CFIFNNEQL

SEQ ID NO: 1385742 - protein, 9 aa, Homo Sapiens
MAVKLHPHD

SEQ ID NO: 1385743 - protein, 9 aa, Homo Sapiens
FSSACSIAM

SEQ ID NO: 1385744 - protein, 9 aa, Homo Sapiens
WTLWLFWMS

SEQ ID NO: 1385745 - protein, 9 aa, Homo Sapiens
TKIETLFEP

SEQ ID NO: 1385746 - protein, 9 aa, Homo Sapiens
DFSITEDLT

SEQ ID NO: 1385747 - protein, 9 aa, Homo Sapiens
YKLRRKNNF

SEQ ID NO: 1385748 - protein, 9 aa, Homo Sapiens
GSCFPKNLV

SEQ ID NO: 1385749 - protein, 9 aa, Homo Sapiens
ITNLPRLQE

SEQ ID NO: 1385750 - protein, 9 aa, Homo Sapiens
IATAILTGV

SEQ ID NO: 1385751 - protein, 9 aa, Homo Sapiens
GEGPSRCPA

SEQ ID NO: 1385752 - protein, 9 aa, Homo Sapiens
TKTTSLFSN

SEQ ID NO: 1385753 - protein, 9 aa, Homo Sapiens
KPVVKVTAT

SEQ ID NO: 1385754 - protein, 9 aa, Homo Sapiens
TISYSMNPQ

SEQ ID NO: 1385755 - protein, 9 aa, Homo Sapiens
LGRPGREPP

SEQ ID NO: 1385756 - protein, 9 aa, Homo Sapiens
FYLETHCTV

SEQ ID NO: 1385757 - protein, 9 aa, Homo Sapiens
HSQEEDFHL

SEQ ID NO: 1385758 - protein, 9 aa, Homo Sapiens
WMRPKKCPL

SEQ ID NO: 1385759 - protein, 9 aa, Homo Sapiens
AQMDEDFSI

SEQ ID NO: 1385760 - protein, 9 aa, Homo Sapiens
GRNALWVAA

SEQ ID NO: 1385761 - protein, 9 aa, Homo Sapiens
ENYVACSCS

SEQ ID NO: 1385762 - protein, 9 aa, Homo Sapiens
GLSTWSALD

SEQ ID NO: 1385763 - protein, 9 aa, Homo Sapiens
SGDVILTGT

SEQ ID NO: 1385764 - protein, 9 aa, Homo Sapiens
KASKRPWSQ

SEQ ID NO: 1385765 - protein, 9 aa, Homo Sapiens
ATSSSGCTS

SEQ ID NO: 1385766 - protein, 9 aa, Homo Sapiens
KSALLGKKM

SEQ ID NO: 1385767 - protein, 9 aa, Homo Sapiens
VPEGLGRLP

SEQ ID NO: 1385768 - protein, 9 aa, Homo Sapiens
PTSSCCSWS

SEQ ID NO: 1385769 - protein, 9 aa, Homo Sapiens
GLSDRPSVS

SEQ ID NO: 1385770 - protein, 9 aa, Homo Sapiens
GAPCFLRSG

SEQ ID NO: 1385771 - protein, 9 aa, Homo Sapiens
GLTSRILDA

SEQ ID NO: 1385772 - protein, 9 aa, Homo Sapiens
KLFSSTVLP

SEQ ID NO: 1385773 - protein, 9 aa, Homo Sapiens
ALQQGAGVQ

SEQ ID NO: 1385774 - protein, 9 aa, Homo Sapiens
LILRFCFKL

SEQ ID NO: 1385775 - protein, 9 aa, Homo Sapiens
GKGRSHVQV

SEQ ID NO: 1385776 - protein, 9 aa, Homo Sapiens
TMGWPRFWA

SEQ ID NO: 1385777 - protein, 9 aa, Homo Sapiens
GMRDRSLST

SEQ ID NO: 1385778 - protein, 9 aa, Homo Sapiens
QTTATCSPS

SEQ ID NO: 1385779 - protein, 9 aa, Homo Sapiens
SRSHGGRRR

SEQ ID NO: 1385780 - protein, 9 aa, Homo Sapiens
FNWYLGEER

SEQ ID NO: 1385781 - protein, 9 aa, Homo Sapiens
SIHTSCCHA

SEQ ID NO: 1385782 - protein, 9 aa, Homo Sapiens
PCTLLPKDR

SEQ ID NO: 1385783 - protein, 9 aa, Homo Sapiens
IWVYVYVDP

SEQ ID NO: 1385784 - protein, 9 aa, Homo Sapiens
AHKEEEDDD

SEQ ID NO: 1385785 - protein, 9 aa, Homo Sapiens
SLRIQQRQD

SEQ ID NO: 1385786 - protein, 9 aa, Homo Sapiens
VSISPSSAS

SEQ ID NO: 1385787 - protein, 9 aa, Homo Sapiens
NVLENLQKS

SEQ ID NO: 1385788 - protein, 9 aa, Homo Sapiens
NFCLKIYDM

SEQ ID NO: 1385789 - protein, 9 aa, Homo Sapiens
SMSTARGLA

SEQ ID NO: 1385790 - protein, 9 aa, Homo Sapiens
TGHTSDAGT

SEQ ID NO: 1385791 - protein, 9 aa, Homo Sapiens
SGLKNIPGI

SEQ ID NO: 1385792 - protein, 9 aa, Homo Sapiens
PEGLGRLPP

SEQ ID NO: 1385793 - protein, 9 aa, Homo Sapiens
PANCDWKPQ

SEQ ID NO: 1385794 - protein, 9 aa, Homo Sapiens
VCIVCVGGL

SEQ ID NO: 1385795 - protein, 9 aa, Homo Sapiens
AALVSWKQS

SEQ ID NO: 1385796 - protein, 9 aa, Homo Sapiens
SRVLDCANN

SEQ ID NO: 1385797 - protein, 9 aa, Homo Sapiens
PNYSMVLQR

SEQ ID NO: 1385798 - protein, 9 aa, Homo Sapiens
VNIAVIIYI

SEQ ID NO: 1385799 - protein, 9 aa, Homo Sapiens
KRKAMTKKR

SEQ ID NO: 1385800 - protein, 9 aa, Homo Sapiens
SPPELVVEI

SEQ ID NO: 1385801 - protein, 9 aa, Homo Sapiens
VGNPYWMAL

SEQ ID NO: 1385802 - protein, 9 aa, Homo Sapiens
NWTPESPGD

SEQ ID NO: 1385803 - protein, 9 aa, Homo Sapiens
SKKCRVNAV

SEQ ID NO: 1385804 - protein, 9 aa, Homo Sapiens
WYNIIGPLD

SEQ ID NO: 1385805 - protein, 9 aa, Homo Sapiens
LHSPHKGPP

SEQ ID NO: 1385806 - protein, 9 aa, Homo Sapiens
DPDAVVASS

SEQ ID NO: 1385807 - protein, 9 aa, Homo Sapiens
EIQNSLLHV

SEQ ID NO: 1385808 - protein, 9 aa, Homo Sapiens
SSTTTGPCP

SEQ ID NO: 1385809 - protein, 9 aa, Homo Sapiens
TVAVPKGEA

SEQ ID NO: 1385810 - protein, 9 aa, Homo Sapiens
LDSGADTGL

SEQ ID NO: 1385811 - protein, 9 aa, Homo Sapiens
RSSLAEEQS

SEQ ID NO: 1385812 - protein, 9 aa, Homo Sapiens
PSLPGPCAS

SEQ ID NO: 1385813 - protein, 9 aa, Homo Sapiens
SCLTPSRWA

SEQ ID NO: 1385814 - protein, 9 aa, Homo Sapiens
DKKKKDKKR

SEQ ID NO: 1385815 - protein, 9 aa, Homo Sapiens
QKSANLWGK

SEQ ID NO: 1385816 - protein, 9 aa, Homo Sapiens
LQKTIRNQG

SEQ ID NO: 1385817 - protein, 9 aa, Homo Sapiens
QDCDQVCDQ

SEQ ID NO: 1385818 - protein, 9 aa, Homo Sapiens
VMKTRTCSW

SEQ ID NO: 1385819 - protein, 9 aa, Homo Sapiens
RLSARMTVT

SEQ ID NO: 1385820 - protein, 9 aa, Homo Sapiens
IDKRMDSIK

SEQ ID NO: 1385821 - protein, 9 aa, Homo Sapiens
DVFEDNTSA

SEQ ID NO: 1385822 - protein, 9 aa, Homo Sapiens
TQGRRWGAW

SEQ ID NO: 1385823 - protein, 9 aa, Homo Sapiens
TPSSPAAAC

SEQ ID NO: 1385824 - protein, 9 aa, Homo Sapiens
DTIECLKRH

SEQ ID NO: 1385825 - protein, 9 aa, Homo Sapiens
GVPELLVGR

SEQ ID NO: 1385826 - protein, 9 aa, Homo Sapiens
YIHTHTFYV

SEQ ID NO: 1385827 - protein, 9 aa, Homo Sapiens
LWDRIVLGR

SEQ ID NO: 1385828 - protein, 9 aa, Homo Sapiens
AEYRYSMAH

SEQ ID NO: 1385829 - protein, 9 aa, Homo Sapiens
LNETQDKAF

SEQ ID NO: 1385830 - protein, 9 aa, Homo Sapiens
APRGPAAPT

SEQ ID NO: 1385831 - protein, 9 aa, Homo Sapiens
HFYLDQWTP

SEQ ID NO: 1385832 - protein, 9 aa, Homo Sapiens
LVASLWGWS

SEQ ID NO: 1385833 - protein, 9 aa, Homo Sapiens
ESPWQVMAS

SEQ ID NO: 1385834 - protein, 9 aa, Homo Sapiens
ECLKRHNAL

SEQ ID NO: 1385835 - protein, 9 aa, Homo Sapiens
NSPPSQPPS

SEQ ID NO: 1385836 - protein, 9 aa, Homo Sapiens
EEAAEARAK

SEQ ID NO: 1385837 - protein, 9 aa, Homo Sapiens
GITNLPRLQ

SEQ ID NO: 1385838 - protein, 9 aa, Homo Sapiens
EQTHWLRPT

SEQ ID NO: 1385839 - protein, 9 aa, Homo Sapiens
FEDFLLVFS

SEQ ID NO: 1385840 - protein, 9 aa, Homo Sapiens
ICLKKGIKI

SEQ ID NO: 1385841 - protein, 9 aa, Homo Sapiens
MLGLLIEVS

SEQ ID NO: 1385842 - protein, 9 aa, Homo Sapiens
FIPMTSHMN

SEQ ID NO: 1385843 - protein, 9 aa, Homo Sapiens
EKFTWATKG

SEQ ID NO: 1385844 - protein, 9 aa, Homo Sapiens
SAPHPPNYS

SEQ ID NO: 1385845 - protein, 9 aa, Homo Sapiens
LRRKNNFRL

SEQ ID NO: 1385846 - protein, 9 aa, Homo Sapiens
PIPMMPASQ

SEQ ID NO: 1385847 - protein, 9 aa, Homo Sapiens
TSEEAQKKL

SEQ ID NO: 1385848 - protein, 9 aa, Homo Sapiens
RRQELPGKE

SEQ ID NO: 1385849 - protein, 9 aa, Homo Sapiens
GPCPAPAPT

SEQ ID NO: 1385850 - protein, 9 aa, Homo Sapiens
DQDKEKEKE

SEQ ID NO: 1385851 - protein, 9 aa, Homo Sapiens
NILENTDSG

SEQ ID NO: 1385852 - protein, 9 aa, Homo Sapiens
KAHWKLQTH

SEQ ID NO: 1385853 - protein, 9 aa, Homo Sapiens
VMVNGVQSC

SEQ ID NO: 1385854 - protein, 9 aa, Homo Sapiens
EEGGCASGT

SEQ ID NO: 1385855 - protein, 9 aa, Homo Sapiens
HSITTQDHQ

SEQ ID NO: 1385856 - protein, 9 aa, Homo Sapiens
MLVNQPLAV

SEQ ID NO: 1385857 - protein, 9 aa, Homo Sapiens
GTVDCNGVV

SEQ ID NO: 1385858 - protein, 9 aa, Homo Sapiens
SKRSSRSNA

SEQ ID NO: 1385859 - protein, 9 aa, Homo Sapiens
FSSTSSFEQ

SEQ ID NO: 1385860 - protein, 9 aa, Homo Sapiens
FLLTIMGYD

SEQ ID NO: 1385861 - protein, 9 aa, Homo Sapiens
LQVLVMVNG

SEQ ID NO: 1385862 - protein, 9 aa, Homo Sapiens
MLKKTSFII

SEQ ID NO: 1385863 - protein, 9 aa, Homo Sapiens
LLPLYFAVD

SEQ ID NO: 1385864 - protein, 9 aa, Homo Sapiens
TAGQKYHSV

SEQ ID NO: 1385865 - protein, 9 aa, Homo Sapiens
SEWQLLRLK

SEQ ID NO: 1385866 - protein, 9 aa, Homo Sapiens
MSRISGFGT

SEQ ID NO: 1385867 - protein, 9 aa, Homo Sapiens
KHSEVMLDD

SEQ ID NO: 1385868 - protein, 9 aa, Homo Sapiens
QRQPLHAVH

SEQ ID NO: 1385869 - protein, 9 aa, Homo Sapiens
PLPLVTRPP

SEQ ID NO: 1385870 - protein, 9 aa, Homo Sapiens
RRWGAWHPG

SEQ ID NO: 1385871 - protein, 9 aa, Homo Sapiens
WMPSLARLL

SEQ ID NO: 1385872 - protein, 9 aa, Homo Sapiens
RIVKNWVSC

SEQ ID NO: 1385873 - protein, 9 aa, Homo Sapiens
LRTISSSVI

SEQ ID NO: 1385874 - protein, 9 aa, Homo Sapiens
EVQQVQLDP

SEQ ID NO: 1385875 - protein, 9 aa, Homo Sapiens
LQGHVYRFC

SEQ ID NO: 1385876 - protein, 9 aa, Homo Sapiens
LGWGPEDGV

SEQ ID NO: 1385877 - protein, 9 aa, Homo Sapiens
LSAVCVMLD

SEQ ID NO: 1385878 - protein, 9 aa, Homo Sapiens
HGGRRRRSR

SEQ ID NO: 1385879 - protein, 9 aa, Homo Sapiens
TFFNSPKSL

SEQ ID NO: 1385880 - protein, 9 aa, Homo Sapiens
TSLHPMTDE

SEQ ID NO: 1385881 - protein, 9 aa, Homo Sapiens
EYRYSMAHS

SEQ ID NO: 1385882 - protein, 9 aa, Homo Sapiens
GLPPAVLGA

SEQ ID NO: 1385883 - protein, 9 aa, Homo Sapiens
PDLVLNVEM

SEQ ID NO: 1385884 - protein, 9 aa, Homo Sapiens
RVPMNSLVP

SEQ ID NO: 1385885 - protein, 9 aa, Homo Sapiens
LAAQTRWWR

SEQ ID NO: 1385886 - protein, 9 aa, Homo Sapiens
QLYIRNLKS

SEQ ID NO: 1385887 - protein, 9 aa, Homo Sapiens
INPTISCPF

SEQ ID NO: 1385888 - protein, 9 aa, Homo Sapiens
IRNLKSCIK

SEQ ID NO: 1385889 - protein, 9 aa, Homo Sapiens
LPERAGASG

SEQ ID NO: 1385890 - protein, 9 aa, Homo Sapiens
AFRLASTTN

SEQ ID NO: 1385891 - protein, 9 aa, Homo Sapiens
NQEQGKHKI

SEQ ID NO: 1385892 - protein, 9 aa, Homo Sapiens
TFPLHQGQV

SEQ ID NO: 1385893 - protein, 9 aa, Homo Sapiens
TRSTTTPPH

SEQ ID NO: 1385894 - protein, 9 aa, Homo Sapiens
PCIQIIEQS

SEQ ID NO: 1385895 - protein, 9 aa, Homo Sapiens
PGVLCCYCP

SEQ ID NO: 1385896 - protein, 9 aa, Homo Sapiens
PVHQPQPME

SEQ ID NO: 1385897 - protein, 9 aa, Homo Sapiens
SRGPPGPNE

SEQ ID NO: 1385898 - protein, 9 aa, Homo Sapiens
LIIPVELLL

SEQ ID NO: 1385899 - protein, 9 aa, Homo Sapiens
YDAWFPDQG

SEQ ID NO: 1385900 - protein, 9 aa, Homo Sapiens
HCLNETQDK

SEQ ID NO: 1385901 - protein, 9 aa, Homo Sapiens
VGGPSRCRS

SEQ ID NO: 1385902 - protein, 9 aa, Homo Sapiens
KYFLLQTTQ

SEQ ID NO: 1385903 - protein, 9 aa, Homo Sapiens
THRLLCLEE

SEQ ID NO: 1385904 - protein, 9 aa, Homo Sapiens
TVEVPKDNK

SEQ ID NO: 1385905 - protein, 9 aa, Homo Sapiens
SWYTVRVPG

SEQ ID NO: 1385906 - protein, 9 aa, Homo Sapiens
SSPSWAWRS

SEQ ID NO: 1385907 - protein, 9 aa, Homo Sapiens
RFWACGRGA

SEQ ID NO: 1385908 - protein, 9 aa, Homo Sapiens
FSDLPSGRR

SEQ ID NO: 1385909 - protein, 9 aa, Homo Sapiens
LEGDSWRSL

SEQ ID NO: 1385910 - protein, 9 aa, Homo Sapiens
SPHKGPPPR

SEQ ID NO: 1385911 - protein, 9 aa, Homo Sapiens
PPSPWNRGS

SEQ ID NO: 1385912 - protein, 9 aa, Homo Sapiens
QLQALAMWE

SEQ ID NO: 1385913 - protein, 9 aa, Homo Sapiens
VPGSPGMQG

SEQ ID NO: 1385914 - protein, 9 aa, Homo Sapiens
VAEEAAASR

SEQ ID NO: 1385915 - protein, 9 aa, Homo Sapiens
PIEAYSSPS

SEQ ID NO: 1385916 - protein, 9 aa, Homo Sapiens
EAQKLTFRV

SEQ ID NO: 1385917 - protein, 9 aa, Homo Sapiens
EQQQQQPLL

SEQ ID NO: 1385918 - protein, 9 aa, Homo Sapiens
NEELNMETL

SEQ ID NO: 1385919 - protein, 9 aa, Homo Sapiens
FETTFPSSW

SEQ ID NO: 1385920 - protein, 9 aa, Homo Sapiens
VLQRLLHPP

SEQ ID NO: 1385921 - protein, 9 aa, Homo Sapiens
LTTHKNSYW

SEQ ID NO: 1385922 - protein, 9 aa, Homo Sapiens
RSRTSGLVV

SEQ ID NO: 1385923 - protein, 9 aa, Homo Sapiens
KEWQRQPLH

SEQ ID NO: 1385924 - protein, 9 aa, Homo Sapiens
CLILVVCRE

SEQ ID NO: 1385925 - protein, 9 aa, Homo Sapiens
RRSQRRRRY

SEQ ID NO: 1385926 - protein, 9 aa, Homo Sapiens
ILGIEIHVS

SEQ ID NO: 1385927 - protein, 9 aa, Homo Sapiens
LDHNPLTTV

SEQ ID NO: 1385928 - protein, 9 aa, Homo Sapiens
RGLHSFYHT

SEQ ID NO: 1385929 - protein, 9 aa, Homo Sapiens
GMRRNLRND

SEQ ID NO: 1385930 - protein, 9 aa, Homo Sapiens
AYSDLFCSL

SEQ ID NO: 1385931 - protein, 9 aa, Homo Sapiens
IAANIQDKH

SEQ ID NO: 1385932 - protein, 9 aa, Homo Sapiens
KKTRTSLHQ

SEQ ID NO: 1385933 - protein, 9 aa, Homo Sapiens
RAYGRLWRP

SEQ ID NO: 1385934 - protein, 9 aa, Homo Sapiens
RISVCGCLA

SEQ ID NO: 1385935 - protein, 9 aa, Homo Sapiens
ALNCGEGTT

SEQ ID NO: 1385936 - protein, 9 aa, Homo Sapiens
EAKKRIMWL

SEQ ID NO: 1385937 - protein, 9 aa, Homo Sapiens
CWSASSPSW

SEQ ID NO: 1385938 - protein, 9 aa, Homo Sapiens
AWFPDQGRY

SEQ ID NO: 1385939 - protein, 9 aa, Homo Sapiens
PCLILVVCR

SEQ ID NO: 1385940 - protein, 9 aa, Homo Sapiens
CVVLEARAP

SEQ ID NO: 1385941 - protein, 9 aa, Homo Sapiens
TLMDDIGSE

SEQ ID NO: 1385942 - protein, 9 aa, Homo Sapiens
SVLYHIAQN

SEQ ID NO: 1385943 - protein, 9 aa, Homo Sapiens
CLEEPPRLH

SEQ ID NO: 1385944 - protein, 9 aa, Homo Sapiens
VCGKAYISC

SEQ ID NO: 1385945 - protein, 9 aa, Homo Sapiens
KRGASSSTS

SEQ ID NO: 1385946 - protein, 9 aa, Homo Sapiens
YFGELPLLL

SEQ ID NO: 1385947 - protein, 9 aa, Homo Sapiens
WSQKTEKVQ

SEQ ID NO: 1385948 - protein, 9 aa, Homo Sapiens
EGGPEAPST

SEQ ID NO: 1385949 - protein, 9 aa, Homo Sapiens
RGPPSRGPP

SEQ ID NO: 1385950 - protein, 9 aa, Homo Sapiens
CRPRTRTCP

SEQ ID NO: 1385951 - protein, 9 aa, Homo Sapiens
AARGIKEPN

SEQ ID NO: 1385952 - protein, 9 aa, Homo Sapiens
PHKGPPPRP

SEQ ID NO: 1385953 - protein, 9 aa, Homo Sapiens
IQLCLLCPG

SEQ ID NO: 1385954 - protein, 9 aa, Homo Sapiens
PIPVRPMGA

SEQ ID NO: 1385955 - protein, 9 aa, Homo Sapiens
IIKDIFLMK

SEQ ID NO: 1385956 - protein, 9 aa, Homo Sapiens
YTKKPLYEN

SEQ ID NO: 1385957 - protein, 9 aa, Homo Sapiens
TLPFEVVLQ

SEQ ID NO: 1385958 - protein, 9 aa, Homo Sapiens
ACAQWSPVV

SEQ ID NO: 1385959 - protein, 9 aa, Homo Sapiens
GSWSWQVSL

SEQ ID NO: 1385960 - protein, 9 aa, Homo Sapiens
PTKYLNCIR

SEQ ID NO: 1385961 - protein, 9 aa, Homo Sapiens
ASPTKIETL

SEQ ID NO: 1385962 - protein, 9 aa, Homo Sapiens
KGSKPLCVK

SEQ ID NO: 1385963 - protein, 9 aa, Homo Sapiens
APVEGEAKR

SEQ ID NO: 1385964 - protein, 9 aa, Homo Sapiens
DSYGEDYFH

SEQ ID NO: 1385965 - protein, 9 aa, Homo Sapiens
PHPGQQDGK

SEQ ID NO: 1385966 - protein, 9 aa, Homo Sapiens
FTSPTIPIN

SEQ ID NO: 1385967 - protein, 9 aa, Homo Sapiens
FLCFSSEGG

SEQ ID NO: 1385968 - protein, 9 aa, Homo Sapiens
FPPLGGGGI

SEQ ID NO: 1385969 - protein, 9 aa, Homo Sapiens
WKPQWLRAT

SEQ ID NO: 1385970 - protein, 9 aa, Homo Sapiens
SSERAGDIQ

SEQ ID NO: 1385971 - protein, 9 aa, Homo Sapiens
CFLRSGMRD

SEQ ID NO: 1385972 - protein, 9 aa, Homo Sapiens
TRAAPPSLR

SEQ ID NO: 1385973 - protein, 9 aa, Homo Sapiens
LPLPLVTRP

SEQ ID NO: 1385974 - protein, 9 aa, Homo Sapiens
QEKYFLLQT

SEQ ID NO: 1385975 - protein, 9 aa, Homo Sapiens
QVNRIDETK

SEQ ID NO: 1385976 - protein, 9 aa, Homo Sapiens
CIELIERLN

SEQ ID NO: 1385977 - protein, 9 aa, Homo Sapiens
KSCIKWLRK

SEQ ID NO: 1385978 - protein, 9 aa, Homo Sapiens
HHEFFMPEL

SEQ ID NO: 1385979 - protein, 9 aa, Homo Sapiens
KDKKRRNLQ

SEQ ID NO: 1385980 - protein, 9 aa, Homo Sapiens
PQASWNLSQ

SEQ ID NO: 1385981 - protein, 9 aa, Homo Sapiens
RRQLRKAIT

SEQ ID NO: 1385982 - protein, 9 aa, Homo Sapiens
EIHVSVEFQ

SEQ ID NO: 1385983 - protein, 9 aa, Homo Sapiens
YWEWPAVPS

SEQ ID NO: 1385984 - protein, 9 aa, Homo Sapiens
LTIWLFKHH

SEQ ID NO: 1385985 - protein, 9 aa, Homo Sapiens
VIIAMYMKG

SEQ ID NO: 1385986 - protein, 9 aa, Homo Sapiens
RYWVPVEYA

SEQ ID NO: 1385987 - protein, 9 aa, Homo Sapiens
HLQPEFKTR

SEQ ID NO: 1385988 - protein, 9 aa, Homo Sapiens
PRVECLEEF

SEQ ID NO: 1385989 - protein, 9 aa, Homo Sapiens
YRLQSECQK

SEQ ID NO: 1385990 - protein, 9 aa, Homo Sapiens
VAWDPVPYS

SEQ ID NO: 1385991 - protein, 9 aa, Homo Sapiens
HQMILTPIE

SEQ ID NO: 1385992 - protein, 9 aa, Homo Sapiens
VPSSCTYSA

SEQ ID NO: 1385993 - protein, 9 aa, Homo Sapiens
LGDRCAGIV

SEQ ID NO: 1385994 - protein, 9 aa, Homo Sapiens
LGAGVHGTS

SEQ ID NO: 1385995 - protein, 9 aa, Homo Sapiens
RVGNMARPL

SEQ ID NO: 1385996 - protein, 9 aa, Homo Sapiens
ENEKVVLVT

SEQ ID NO: 1385997 - protein, 9 aa, Homo Sapiens
QLVVLDVDT

SEQ ID NO: 1385998 - protein, 9 aa, Homo Sapiens
TTQCLGLMA

SEQ ID NO: 1385999 - protein, 9 aa, Homo Sapiens
QVIIAMYMK

SEQ ID NO: 1386000 - protein, 9 aa, Homo Sapiens
VNIRGIDKI

SEQ ID NO: 1386001 - protein, 9 aa, Homo Sapiens
YVNFITNPL

SEQ ID NO: 1386002 - protein, 9 aa, Homo Sapiens
IGSQQYKLG

SEQ ID NO: 1386003 - protein, 9 aa, Homo Sapiens
FLLQTTQVN

SEQ ID NO: 1386004 - protein, 9 aa, Homo Sapiens
NCDEIHDLV

SEQ ID NO: 1386005 - protein, 9 aa, Homo Sapiens
WEWPAVPSS

SEQ ID NO: 1386006 - protein, 9 aa, Homo Sapiens
NSREDKRER

SEQ ID NO: 1386007 - protein, 9 aa, Homo Sapiens
STLERLTNS

SEQ ID NO: 1386008 - protein, 9 aa, Homo Sapiens
YLLILRFCF

SEQ ID NO: 1386009 - protein, 9 aa, Homo Sapiens
IADSQLAEC

SEQ ID NO: 1386010 - protein, 9 aa, Homo Sapiens
ICVASLKGG

SEQ ID NO: 1386011 - protein, 9 aa, Homo Sapiens
DALVTRYQS

SEQ ID NO: 1386012 - protein, 9 aa, Homo Sapiens
MYITSKPIV

SEQ ID NO: 1386013 - protein, 9 aa, Homo Sapiens
KCNRAICRQ

SEQ ID NO: 1386014 - protein, 9 aa, Homo Sapiens
DSQVETTFC

SEQ ID NO: 1386015 - protein, 9 aa, Homo Sapiens
RPRPGQPTA

SEQ ID NO: 1386016 - protein, 9 aa, Homo Sapiens
MKRIAEITD

SEQ ID NO: 1386017 - protein, 9 aa, Homo Sapiens
FKLMVLLKT

SEQ ID NO: 1386018 - protein, 9 aa, Homo Sapiens
LHAELRAEL

SEQ ID NO: 1386019 - protein, 9 aa, Homo Sapiens
SEADGLDSG

SEQ ID NO: 1386020 - protein, 9 aa, Homo Sapiens
EKLSAGQNA

SEQ ID NO: 1386021 - protein, 9 aa, Homo Sapiens
PAAALCSAR

SEQ ID NO: 1386022 - protein, 9 aa, Homo Sapiens
TSAGCSTTA

SEQ ID NO: 1386023 - protein, 9 aa, Homo Sapiens
KDVVCKVHI

SEQ ID NO: 1386024 - protein, 9 aa, Homo Sapiens
MDRQSFNKF

SEQ ID NO: 1386025 - protein, 9 aa, Homo Sapiens
HFWTSAGEG

SEQ ID NO: 1386026 - protein, 9 aa, Homo Sapiens
KILHKADML

SEQ ID NO: 1386027 - protein, 9 aa, Homo Sapiens
GLHRHRGQH

SEQ ID NO: 1386028 - protein, 9 aa, Homo Sapiens
PCRWLKMCP

SEQ ID NO: 1386029 - protein, 9 aa, Homo Sapiens
SHCSTSFLW

SEQ ID NO: 1386030 - protein, 9 aa, Homo Sapiens
AISARSWPT

SEQ ID NO: 1386031 - protein, 9 aa, Homo Sapiens
EARAPHVCQ

SEQ ID NO: 1386032 - protein, 9 aa, Homo Sapiens
FHIYTDKLK

SEQ ID NO: 1386033 - protein, 9 aa, Homo Sapiens
GRFRRDHAA

SEQ ID NO: 1386034 - protein, 9 aa, Homo Sapiens
ITGVISWIR

SEQ ID NO: 1386035 - protein, 9 aa, Homo Sapiens
IYVFMNQQF

SEQ ID NO: 1386036 - protein, 9 aa, Homo Sapiens
ITIHWTCGL

SEQ ID NO: 1386037 - protein, 9 aa, Homo Sapiens
TLIQQAMMV

SEQ ID NO: 1386038 - protein, 9 aa, Homo Sapiens
VGTSSSAVS

SEQ ID NO: 1386039 - protein, 9 aa, Homo Sapiens
NTSATREPS

SEQ ID NO: 1386040 - protein, 9 aa, Homo Sapiens
CADYFKNVA

SEQ ID NO: 1386041 - protein, 9 aa, Homo Sapiens
VVLVCVPRR

SEQ ID NO: 1386042 - protein, 9 aa, Homo Sapiens
ALEVTFPPG

SEQ ID NO: 1386043 - protein, 9 aa, Homo Sapiens
IEVQIGGNP

SEQ ID NO: 1386044 - protein, 9 aa, Homo Sapiens
TPIEWEIRL

SEQ ID NO: 1386045 - protein, 9 aa, Homo Sapiens
VLSLPRVPM

SEQ ID NO: 1386046 - protein, 9 aa, Homo Sapiens
GPPGRPGLQ

SEQ ID NO: 1386047 - protein, 9 aa, Homo Sapiens
HEKSTGLQY

SEQ ID NO: 1386048 - protein, 9 aa, Homo Sapiens
PASQTQIPQ

SEQ ID NO: 1386049 - protein, 9 aa, Homo Sapiens
FQGNTVQLH

SEQ ID NO: 1386050 - protein, 9 aa, Homo Sapiens
LSPHTSYRE

SEQ ID NO: 1386051 - protein, 9 aa, Homo Sapiens
TNWKNMVRK

SEQ ID NO: 1386052 - protein, 9 aa, Homo Sapiens
RVEFSGESK

SEQ ID NO: 1386053 - protein, 9 aa, Homo Sapiens
SPPWSPSTQ

SEQ ID NO: 1386054 - protein, 9 aa, Homo Sapiens
PPANGAPPE

SEQ ID NO: 1386055 - protein, 9 aa, Homo Sapiens
HRDIKPANM

SEQ ID NO: 1386056 - protein, 9 aa, Homo Sapiens
PQPPELVSA

SEQ ID NO: 1386057 - protein, 9 aa, Homo Sapiens
MKMEFRTSM

SEQ ID NO: 1386058 - protein, 9 aa, Homo Sapiens
ELFHCLNET

SEQ ID NO: 1386059 - protein, 9 aa, Homo Sapiens
NMVGCLAWL

SEQ ID NO: 1386060 - protein, 9 aa, Homo Sapiens
DSSHTQRQP

SEQ ID NO: 1386061 - protein, 9 aa, Homo Sapiens
EWQRQPLHA

SEQ ID NO: 1386062 - protein, 9 aa, Homo Sapiens
CINPLKSPT

SEQ ID NO: 1386063 - protein, 9 aa, Homo Sapiens
YAPRLAPLL

SEQ ID NO: 1386064 - protein, 9 aa, Homo Sapiens
FKELGKGAF

SEQ ID NO: 1386065 - protein, 9 aa, Homo Sapiens
PPSSPPPRP

SEQ ID NO: 1386066 - protein, 9 aa, Homo Sapiens
WTAPRGPAA

SEQ ID NO: 1386067 - protein, 9 aa, Homo Sapiens
TSTAHVHIR

SEQ ID NO: 1386068 - protein, 9 aa, Homo Sapiens
SLARLLAGS

SEQ ID NO: 1386069 - protein, 9 aa, Homo Sapiens
HCDMYVKVF

SEQ ID NO: 1386070 - protein, 9 aa, Homo Sapiens
QETRSSSES

SEQ ID NO: 1386071 - protein, 9 aa, Homo Sapiens
FKYPSIQAC

SEQ ID NO: 1386072 - protein, 9 aa, Homo Sapiens
NGKMHGTVD

SEQ ID NO: 1386073 - protein, 9 aa, Homo Sapiens
VLSCMGGGL

SEQ ID NO: 1386074 - protein, 9 aa, Homo Sapiens
ISTQVSPTR

SEQ ID NO: 1386075 - protein, 9 aa, Homo Sapiens
MILTKQIKT

SEQ ID NO: 1386076 - protein, 9 aa, Homo Sapiens
RPGQPTALF

SEQ ID NO: 1386077 - protein, 9 aa, Homo Sapiens
LLSEKKFLK

SEQ ID NO: 1386078 - protein, 9 aa, Homo Sapiens
EDGEPLSSE

SEQ ID NO: 1386079 - protein, 9 aa, Homo Sapiens
VLNVEMVQQ

SEQ ID NO: 1386080 - protein, 9 aa, Homo Sapiens
NAVTKIDAA

SEQ ID NO: 1386081 - protein, 9 aa, Homo Sapiens
TLGDEVFDR

SEQ ID NO: 1386082 - protein, 9 aa, Homo Sapiens
SFGPVMVYQ

SEQ ID NO: 1386083 - protein, 9 aa, Homo Sapiens
DFIEGGADG

SEQ ID NO: 1386084 - protein, 9 aa, Homo Sapiens
SGEVQQVQL

SEQ ID NO: 1386085 - protein, 9 aa, Homo Sapiens
DAVAVPFLS

SEQ ID NO: 1386086 - protein, 9 aa, Homo Sapiens
RGLPPAVLG

SEQ ID NO: 1386087 - protein, 9 aa, Homo Sapiens
YSYLDSSAY

SEQ ID NO: 1386088 - protein, 9 aa, Homo Sapiens
VLLLSAIVS

SEQ ID NO: 1386089 - protein, 9 aa, Homo Sapiens
SMVLQRLLH

SEQ ID NO: 1386090 - protein, 9 aa, Homo Sapiens
SNNIVVHPS

SEQ ID NO: 1386091 - protein, 9 aa, Homo Sapiens
AEEDDDEEE

SEQ ID NO: 1386092 - protein, 9 aa, Homo Sapiens
AANLEKIYR

SEQ ID NO: 1386093 - protein, 9 aa, Homo Sapiens
VAYEDGKLL

SEQ ID NO: 1386094 - protein, 9 aa, Homo Sapiens
EDFSITEDL

SEQ ID NO: 1386095 - protein, 9 aa, Homo Sapiens
YIKPCYYSS

SEQ ID NO: 1386096 - protein, 9 aa, Homo Sapiens
EHEKDQDKE

SEQ ID NO: 1386097 - protein, 9 aa, Homo Sapiens
PTRCCRPRT

SEQ ID NO: 1386098 - protein, 9 aa, Homo Sapiens
EIFGRITTG

SEQ ID NO: 1386099 - protein, 9 aa, Homo Sapiens
PQCPQASWN

SEQ ID NO: 1386100 - protein, 9 aa, Homo Sapiens
PERIHLHHN

SEQ ID NO: 1386101 - protein, 9 aa, Homo Sapiens
GTSSSAVSS

SEQ ID NO: 1386102 - protein, 9 aa, Homo Sapiens
CTYSALIAG

SEQ ID NO: 1386103 - protein, 9 aa, Homo Sapiens
SQQLHHGSQ

SEQ ID NO: 1386104 - protein, 9 aa, Homo Sapiens
TSAVSAPQT

SEQ ID NO: 1386105 - protein, 9 aa, Homo Sapiens
THSFLLTIM

SEQ ID NO: 1386106 - protein, 9 aa, Homo Sapiens
TGTHPRKVA

SEQ ID NO: 1386107 - protein, 9 aa, Homo Sapiens
GEDQRLCHG

SEQ ID NO: 1386108 - protein, 9 aa, Homo Sapiens
LFHPEAVHI

SEQ ID NO: 1386109 - protein, 9 aa, Homo Sapiens
QGMRRNLRN

SEQ ID NO: 1386110 - protein, 9 aa, Homo Sapiens
LEKHYLSAQ

SEQ ID NO: 1386111 - protein, 9 aa, Homo Sapiens
PVDRSTPVT

SEQ ID NO: 1386112 - protein, 9 aa, Homo Sapiens
NSPPCTSAV

SEQ ID NO: 1386113 - protein, 9 aa, Homo Sapiens
LFKHHRARF

SEQ ID NO: 1386114 - protein, 9 aa, Homo Sapiens
ASAIAIKLG

SEQ ID NO: 1386115 - protein, 9 aa, Homo Sapiens
FAIGPVGNL

SEQ ID NO: 1386116 - protein, 9 aa, Homo Sapiens
LTKQIKTKP

SEQ ID NO: 1386117 - protein, 9 aa, Homo Sapiens
AAEFQHLQL

SEQ ID NO: 1386118 - protein, 9 aa, Homo Sapiens
MTWSVRITI

SEQ ID NO: 1386119 - protein, 9 aa, Homo Sapiens
RTPLTLAGP

SEQ ID NO: 1386120 - protein, 9 aa, Homo Sapiens
MGGRHPSWP

SEQ ID NO: 1386121 - protein, 9 aa, Homo Sapiens
PCEAPFCCQ

SEQ ID NO: 1386122 - protein, 9 aa, Homo Sapiens
LGSWYTVRV

SEQ ID NO: 1386123 - protein, 9 aa, Homo Sapiens
DLLVGAPCF

SEQ ID NO: 1386124 - protein, 9 aa, Homo Sapiens
IMARDRSVH

SEQ ID NO: 1386125 - protein, 9 aa, Homo Sapiens
SERRHVFGK

SEQ ID NO: 1386126 - protein, 9 aa, Homo Sapiens
TSSSCSTPP

SEQ ID NO: 1386127 - protein, 9 aa, Homo Sapiens
GTWLTAWTC

SEQ ID NO: 1386128 - protein, 9 aa, Homo Sapiens
LYSCGICKN

SEQ ID NO: 1386129 - protein, 9 aa, Homo Sapiens
LWMSSGSLG

SEQ ID NO: 1386130 - protein, 9 aa, Homo Sapiens
MCLTSSMKS

SEQ ID NO: 1386131 - protein, 9 aa, Homo Sapiens
FYIPHVHVS

SEQ ID NO: 1386132 - protein, 9 aa, Homo Sapiens
RPPSPWNRG

SEQ ID NO: 1386133 - protein, 9 aa, Homo Sapiens
RISRPPVTA

SEQ ID NO: 1386134 - protein, 9 aa, Homo Sapiens
KACPISRLS

SEQ ID NO: 1386135 - protein, 9 aa, Homo Sapiens
NFLCGRHMC

SEQ ID NO: 1386136 - protein, 9 aa, Homo Sapiens
EDGKLLCRQ

SEQ ID NO: 1386137 - protein, 9 aa, Homo Sapiens
PQRSSQSLG

SEQ ID NO: 1386138 - protein, 9 aa, Homo Sapiens
ISLPTKMVE

SEQ ID NO: 1386139 - protein, 9 aa, Homo Sapiens
QLGMRVRML

SEQ ID NO: 1386140 - protein, 9 aa, Homo Sapiens
WGSSKSGKL

SEQ ID NO: 1386141 - protein, 9 aa, Homo Sapiens
AMAFDCFVA

SEQ ID NO: 1386142 - protein, 9 aa, Homo Sapiens
VRITIHWTC

SEQ ID NO: 1386143 - protein, 9 aa, Homo Sapiens
GARAPAPTC

SEQ ID NO: 1386144 - protein, 9 aa, Homo Sapiens
VDENAVTKI

SEQ ID NO: 1386145 - protein, 9 aa, Homo Sapiens
MGGGLALWR

SEQ ID NO: 1386146 - protein, 9 aa, Homo Sapiens
NDPWKNPAL

SEQ ID NO: 1386147 - protein, 9 aa, Homo Sapiens
KVTVTPRES

SEQ ID NO: 1386148 - protein, 9 aa, Homo Sapiens
TRVENVNPY

SEQ ID NO: 1386149 - protein, 9 aa, Homo Sapiens
PVNFLCGRH

SEQ ID NO: 1386150 - protein, 9 aa, Homo Sapiens
DPLEKAMLM

SEQ ID NO: 1386151 - protein, 9 aa, Homo Sapiens
PTVSQARLS

SEQ ID NO: 1386152 - protein, 9 aa, Homo Sapiens
NGLVAYEDG

SEQ ID NO: 1386153 - protein, 9 aa, Homo Sapiens
LVLTFNNLT

SEQ ID NO: 1386154 - protein, 9 aa, Homo Sapiens
GFPGGGGGP

SEQ ID NO: 1386155 - protein, 9 aa, Homo Sapiens
PYWKEDLPM

SEQ ID NO: 1386156 - protein, 9 aa, Homo Sapiens
CDEIHDLVK

SEQ ID NO: 1386157 - protein, 9 aa, Homo Sapiens
LWLFWMSPR

SEQ ID NO: 1386158 - protein, 9 aa, Homo Sapiens
FTSAHPSRP

SEQ ID NO: 1386159 - protein, 9 aa, Homo Sapiens
EENDTTLQE

SEQ ID NO: 1386160 - protein, 9 aa, Homo Sapiens
PAVAAPSSD

SEQ ID NO: 1386161 - protein, 9 aa, Homo Sapiens
PKDNKSKIC

SEQ ID NO: 1386162 - protein, 9 aa, Homo Sapiens
GRLGGVLPC

SEQ ID NO: 1386163 - protein, 9 aa, Homo Sapiens
NREPFTMHS

SEQ ID NO: 1386164 - protein, 9 aa, Homo Sapiens
ELPGKELNS

SEQ ID NO: 1386165 - protein, 9 aa, Homo Sapiens
LLVYIMSTT

SEQ ID NO: 1386166 - protein, 9 aa, Homo Sapiens
NQMAGRPGH

SEQ ID NO: 1386167 - protein, 9 aa, Homo Sapiens
CPVHQPQPM

SEQ ID NO: 1386168 - protein, 9 aa, Homo Sapiens
VAAVVVPAE

SEQ ID NO: 1386169 - protein, 9 aa, Homo Sapiens
RSSPKLFSS

SEQ ID NO: 1386170 - protein, 9 aa, Homo Sapiens
ASSSKSFIS

SEQ ID NO: 1386171 - protein, 9 aa, Homo Sapiens
RPEVGGPGQ

SEQ ID NO: 1386172 - protein, 9 aa, Homo Sapiens
PNINFQCAY

SEQ ID NO: 1386173 - protein, 9 aa, Homo Sapiens
VSLTCHFHV

SEQ ID NO: 1386174 - protein, 9 aa, Homo Sapiens
QLLGMCLTS

SEQ ID NO: 1386175 - protein, 9 aa, Homo Sapiens
NYGDVYGIC

SEQ ID NO: 1386176 - protein, 9 aa, Homo Sapiens
FYQHNWLPA

SEQ ID NO: 1386177 - protein, 9 aa, Homo Sapiens
TEGTWDQDG

SEQ ID NO: 1386178 - protein, 9 aa, Homo Sapiens
NHSKEVAVG

SEQ ID NO: 1386179 - protein, 9 aa, Homo Sapiens
SLSSFLIFF

SEQ ID NO: 1386180 - protein, 9 aa, Homo Sapiens
NIVVHPSRS

SEQ ID NO: 1386181 - protein, 9 aa, Homo Sapiens
IFDGRHVLD

SEQ ID NO: 1386182 - protein, 9 aa, Homo Sapiens
TVLAVVQKL

SEQ ID NO: 1386183 - protein, 9 aa, Homo Sapiens
SPVECRNLF

SEQ ID NO: 1386184 - protein, 9 aa, Homo Sapiens
QAIKMGRYE

SEQ ID NO: 1386185 - protein, 9 aa, Homo Sapiens
GGFWLSLLY

SEQ ID NO: 1386186 - protein, 9 aa, Homo Sapiens
TPHYIRRHP

SEQ ID NO: 1386187 - protein, 9 aa, Homo Sapiens
CAPGRVAEP

SEQ ID NO: 1386188 - protein, 9 aa, Homo Sapiens
NCDWKPQWL

SEQ ID NO: 1386189 - protein, 9 aa, Homo Sapiens
MAAEVSPSA

SEQ ID NO: 1386190 - protein, 9 aa, Homo Sapiens
RQSRHSRNC

SEQ ID NO: 1386191 - protein, 9 aa, Homo Sapiens
TASALTLGA

SEQ ID NO: 1386192 - protein, 9 aa, Homo Sapiens
QPTPWAEEE

SEQ ID NO: 1386193 - protein, 9 aa, Homo Sapiens
QTFPLHQGQ

SEQ ID NO: 1386194 - protein, 9 aa, Homo Sapiens
NPYWMALRC

SEQ ID NO: 1386195 - protein, 9 aa, Homo Sapiens
YVRHVLSCM

SEQ ID NO: 1386196 - protein, 9 aa, Homo Sapiens
IGGFWLSLL

SEQ ID NO: 1386197 - protein, 9 aa, Homo Sapiens
ARSEGKGRS

SEQ ID NO: 1386198 - protein, 9 aa, Homo Sapiens
VHHTDHPRA

SEQ ID NO: 1386199 - protein, 9 aa, Homo Sapiens
RTACDITAW

SEQ ID NO: 1386200 - protein, 9 aa, Homo Sapiens
AGGRSGRAL

SEQ ID NO: 1386201 - protein, 9 aa, Homo Sapiens
SLPTKMVEK

SEQ ID NO: 1386202 - protein, 9 aa, Homo Sapiens
PPQPQPDPH

SEQ ID NO: 1386203 - protein, 9 aa, Homo Sapiens
KRGKSQGGR

SEQ ID NO: 1386204 - protein, 9 aa, Homo Sapiens
SLDQLPMTS

SEQ ID NO: 1386205 - protein, 9 aa, Homo Sapiens
TIFGNSAMS

SEQ ID NO: 1386206 - protein, 9 aa, Homo Sapiens
QKTVPPEPG

SEQ ID NO: 1386207 - protein, 9 aa, Homo Sapiens
LMAVDWTLT

SEQ ID NO: 1386208 - protein, 9 aa, Homo Sapiens
ELPLLLAAC

SEQ ID NO: 1386209 - protein, 9 aa, Homo Sapiens
LLGIFKVTR

SEQ ID NO: 1386210 - protein, 9 aa, Homo Sapiens
ACPISRLSC

SEQ ID NO: 1386211 - protein, 9 aa, Homo Sapiens
REDDRVGAG

SEQ ID NO: 1386212 - protein, 9 aa, Homo Sapiens
NIRGIDKIY

SEQ ID NO: 1386213 - protein, 9 aa, Homo Sapiens
YGGRSTGLT

SEQ ID NO: 1386214 - protein, 9 aa, Homo Sapiens
VSWKQSQQS

SEQ ID NO: 1386215 - protein, 9 aa, Homo Sapiens
ARRVIVERI

SEQ ID NO: 1386216 - protein, 9 aa, Homo Sapiens
MLGSWYTVR

SEQ ID NO: 1386217 - protein, 9 aa, Homo Sapiens
LVAMAFDCF

SEQ ID NO: 1386218 - protein, 9 aa, Homo Sapiens
SRLRGPGPL

SEQ ID NO: 1386219 - protein, 9 aa, Homo Sapiens
GPSLPQEQK

SEQ ID NO: 1386220 - protein, 9 aa, Homo Sapiens
VGGPGQSAP

SEQ ID NO: 1386221 - protein, 9 aa, Homo Sapiens
FDLLGQPMI

SEQ ID NO: 1386222 - protein, 9 aa, Homo Sapiens
ACSYLSLKD

SEQ ID NO: 1386223 - protein, 9 aa, Homo Sapiens
SKTRAPRRC

SEQ ID NO: 1386224 - protein, 9 aa, Homo Sapiens
PLWRSTGGW

SEQ ID NO: 1386225 - protein, 9 aa, Homo Sapiens
GRPGGEDQR

SEQ ID NO: 1386226 - protein, 9 aa, Homo Sapiens
NILPKSTWD

SEQ ID NO: 1386227 - protein, 9 aa, Homo Sapiens
FRTQESTAK

SEQ ID NO: 1386228 - protein, 9 aa, Homo Sapiens
TGSAPRAPP

SEQ ID NO: 1386229 - protein, 9 aa, Homo Sapiens
SHQPAAPGL

SEQ ID NO: 1386230 - protein, 9 aa, Homo Sapiens
PTGPAAPPW

SEQ ID NO: 1386231 - protein, 9 aa, Homo Sapiens
EPGIPGDRG

SEQ ID NO: 1386232 - protein, 9 aa, Homo Sapiens
WTLLILTTL

SEQ ID NO: 1386233 - protein, 9 aa, Homo Sapiens
SLMGLCVDM

SEQ ID NO: 1386234 - protein, 9 aa, Homo Sapiens
LSILKLQRG

SEQ ID NO: 1386235 - protein, 9 aa, Homo Sapiens
PLEAMLRYL

SEQ ID NO: 1386236 - protein, 9 aa, Homo Sapiens
TACLDFLWR

SEQ ID NO: 1386237 - protein, 9 aa, Homo Sapiens
TQIFICFIE

SEQ ID NO: 1386238 - protein, 9 aa, Homo Sapiens
QRSSQSLGR

SEQ ID NO: 1386239 - protein, 9 aa, Homo Sapiens
LGPEALSFT

SEQ ID NO: 1386240 - protein, 9 aa, Homo Sapiens
LIEDIVCDG

SEQ ID NO: 1386241 - protein, 9 aa, Homo Sapiens
PESKQTAPK

SEQ ID NO: 1386242 - protein, 9 aa, Homo Sapiens
GPSRCRSRL

SEQ ID NO: 1386243 - protein, 9 aa, Homo Sapiens
MCPLNPAAQ

SEQ ID NO: 1386244 - protein, 9 aa, Homo Sapiens
GHSGSETGL

SEQ ID NO: 1386245 - protein, 9 aa, Homo Sapiens
KGQKFGLDL

SEQ ID NO: 1386246 - protein, 9 aa, Homo Sapiens
LRIKRKKKK

SEQ ID NO: 1386247 - protein, 9 aa, Homo Sapiens
KVLSVLKHP

SEQ ID NO: 1386248 - protein, 9 aa, Homo Sapiens
GEEGPGLGA

SEQ ID NO: 1386249 - protein, 9 aa, Homo Sapiens
RFTSPKVTL

SEQ ID NO: 1386250 - protein, 9 aa, Homo Sapiens
WLQAIKMGR

SEQ ID NO: 1386251 - protein, 9 aa, Homo Sapiens
GDLGNGDFQ

SEQ ID NO: 1386252 - protein, 9 aa, Homo Sapiens
VLGILIFRD

SEQ ID NO: 1386253 - protein, 9 aa, Homo Sapiens
PPQCPQASW

SEQ ID NO: 1386254 - protein, 9 aa, Homo Sapiens
MELPACAQW

SEQ ID NO: 1386255 - protein, 9 aa, Homo Sapiens
HSGSETGLC

SEQ ID NO: 1386256 - protein, 9 aa, Homo Sapiens
TTNVEKRRQ

SEQ ID NO: 1386257 - protein, 9 aa, Homo Sapiens
SEGKGRSHV

SEQ ID NO: 1386258 - protein, 9 aa, Homo Sapiens
LKRSKEPNL

SEQ ID NO: 1386259 - protein, 9 aa, Homo Sapiens
GRAPSSPAS

SEQ ID NO: 1386260 - protein, 9 aa, Homo Sapiens
TSTEEMEPS

SEQ ID NO: 1386261 - protein, 9 aa, Homo Sapiens
RSVYIKPCY

SEQ ID NO: 1386262 - protein, 9 aa, Homo Sapiens
TPTKYLNCI

SEQ ID NO: 1386263 - protein, 9 aa, Homo Sapiens
SRSNAYFYG

SEQ ID NO: 1386264 - protein, 9 aa, Homo Sapiens
LEKAMLMAV

SEQ ID NO: 1386265 - protein, 9 aa, Homo Sapiens
VHLAFSPGH

SEQ ID NO: 1386266 - protein, 9 aa, Homo Sapiens
PPPAPPAAL

SEQ ID NO: 1386267 - protein, 9 aa, Homo Sapiens
PTKLLKNIL

SEQ ID NO: 1386268 - protein, 9 aa, Homo Sapiens
RKLSSPTTH

SEQ ID NO: 1386269 - protein, 9 aa, Homo Sapiens
RAGRMGGRH

SEQ ID NO: 1386270 - protein, 9 aa, Homo Sapiens
ILLPCEAPF

SEQ ID NO: 1386271 - protein, 9 aa, Homo Sapiens
DLFSSCTLD

SEQ ID NO: 1386272 - protein, 9 aa, Homo Sapiens
KGDEKGNEN

SEQ ID NO: 1386273 - protein, 9 aa, Homo Sapiens
VLDQSDNDM

SEQ ID NO: 1386274 - protein, 9 aa, Homo Sapiens
SSGSCPSLY

SEQ ID NO: 1386275 - protein, 9 aa, Homo Sapiens
KRGAEDPCF

SEQ ID NO: 1386276 - protein, 9 aa, Homo Sapiens
ECSPAAPPP

SEQ ID NO: 1386277 - protein, 9 aa, Homo Sapiens
SSSVLVATV

SEQ ID NO: 1386278 - protein, 9 aa, Homo Sapiens
MKMVLVLVF

SEQ ID NO: 1386279 - protein, 9 aa, Homo Sapiens
DSWRSLLSF

SEQ ID NO: 1386280 - protein, 9 aa, Homo Sapiens
FAFSFPWGT

SEQ ID NO: 1386281 - protein, 9 aa, Homo Sapiens
FLLNNFLKH

SEQ ID NO: 1386282 - protein, 9 aa, Homo Sapiens
SLVQPGVLC

SEQ ID NO: 1386283 - protein, 9 aa, Homo Sapiens
WCGHELPGG

SEQ ID NO: 1386284 - protein, 9 aa, Homo Sapiens
GRTAAVGKA

SEQ ID NO: 1386285 - protein, 9 aa, Homo Sapiens
TDHVSDSFL

SEQ ID NO: 1386286 - protein, 9 aa, Homo Sapiens
DHIKRPVNA

SEQ ID NO: 1386287 - protein, 9 aa, Homo Sapiens
TDKNGFKAR

SEQ ID NO: 1386288 - protein, 9 aa, Homo Sapiens
GFSESSHLQ

SEQ ID NO: 1386289 - protein, 9 aa, Homo Sapiens
ATECLLLVV

SEQ ID NO: 1386290 - protein, 9 aa, Homo Sapiens
LPKSTWDLP

SEQ ID NO: 1386291 - protein, 9 aa, Homo Sapiens
HCTWDPGMD

SEQ ID NO: 1386292 - protein, 9 aa, Homo Sapiens
SLNRMPSVT

SEQ ID NO: 1386293 - protein, 9 aa, Homo Sapiens
VYPEKILSD

SEQ ID NO: 1386294 - protein, 9 aa, Homo Sapiens
TAATSSSGC

SEQ ID NO: 1386295 - protein, 9 aa, Homo Sapiens
VNVNIRGID

SEQ ID NO: 1386296 - protein, 9 aa, Homo Sapiens
YVTPWTLLI

SEQ ID NO: 1386297 - protein, 9 aa, Homo Sapiens
PAFDVTPTT

SEQ ID NO: 1386298 - protein, 9 aa, Homo Sapiens
GLFTSTAHV

SEQ ID NO: 1386299 - protein, 9 aa, Homo Sapiens
TVTRMRQVR

SEQ ID NO: 1386300 - protein, 9 aa, Homo Sapiens
CKDRGKAFI

SEQ ID NO: 1386301 - protein, 9 aa, Homo Sapiens
LVLRFKVLL

SEQ ID NO: 1386302 - protein, 9 aa, Homo Sapiens
ISACPRLLP

SEQ ID NO: 1386303 - protein, 9 aa, Homo Sapiens
GVGGVEAEA

SEQ ID NO: 1386304 - protein, 9 aa, Homo Sapiens
LTMGWPRFW

SEQ ID NO: 1386305 - protein, 9 aa, Homo Sapiens
FRKEKNSRE

SEQ ID NO: 1386306 - protein, 9 aa, Homo Sapiens
VAIQEELGY

SEQ ID NO: 1386307 - protein, 9 aa, Homo Sapiens
ILLQRNLLR

SEQ ID NO: 1386308 - protein, 9 aa, Homo Sapiens
TTHLQARLA

SEQ ID NO: 1386309 - protein, 9 aa, Homo Sapiens
PGKPTLSKK

SEQ ID NO: 1386310 - protein, 9 aa, Homo Sapiens
AALSQTGFS

SEQ ID NO: 1386311 - protein, 9 aa, Homo Sapiens
QRKGVCVAS

SEQ ID NO: 1386312 - protein, 9 aa, Homo Sapiens
KNKDMLVNQ

SEQ ID NO: 1386313 - protein, 9 aa, Homo Sapiens
RLLAGSVGA

SEQ ID NO: 1386314 - protein, 9 aa, Homo Sapiens
GPLGDRCAG

SEQ ID NO: 1386315 - protein, 9 aa, Homo Sapiens
LTSSMKSCK

SEQ ID NO: 1386316 - protein, 9 aa, Homo Sapiens
SHSRRRRNQ

SEQ ID NO: 1386317 - protein, 9 aa, Homo Sapiens
PPSPSSLLS

SEQ ID NO: 1386318 - protein, 9 aa, Homo Sapiens
RARQLRKQK

SEQ ID NO: 1386319 - protein, 9 aa, Homo Sapiens
PACRLHAEL

SEQ ID NO: 1386320 - protein, 9 aa, Homo Sapiens
HMQETKKKR

SEQ ID NO: 1386321 - protein, 9 aa, Homo Sapiens
SHYSQMDQQ

SEQ ID NO: 1386322 - protein, 9 aa, Homo Sapiens
IKPIISETP

SEQ ID NO: 1386323 - protein, 9 aa, Homo Sapiens
GNGDFQMVY

SEQ ID NO: 1386324 - protein, 9 aa, Homo Sapiens
VATVLMIIS

SEQ ID NO: 1386325 - protein, 9 aa, Homo Sapiens
GGNITQHSI

SEQ ID NO: 1386326 - protein, 9 aa, Homo Sapiens
EIWDTAGQK

SEQ ID NO: 1386327 - protein, 9 aa, Homo Sapiens
IFHFPLYWF

SEQ ID NO: 1386328 - protein, 9 aa, Homo Sapiens
TPPHCSPAR

SEQ ID NO: 1386329 - protein, 9 aa, Homo Sapiens
GPVGNLLVV

SEQ ID NO: 1386330 - protein, 9 aa, Homo Sapiens
MEYSYLDSS

SEQ ID NO: 1386331 - protein, 9 aa, Homo Sapiens
QAPGRGSLH

SEQ ID NO: 1386332 - protein, 9 aa, Homo Sapiens
QMQSFGMKT

SEQ ID NO: 1386333 - protein, 9 aa, Homo Sapiens
FPPGTAMPQ

SEQ ID NO: 1386334 - protein, 9 aa, Homo Sapiens
RCRSRLEVM

SEQ ID NO: 1386335 - protein, 9 aa, Homo Sapiens
LKNSFEGQY

SEQ ID NO: 1386336 - protein, 9 aa, Homo Sapiens
SPDVPDMAT

SEQ ID NO: 1386337 - protein, 9 aa, Homo Sapiens
PRLLPYPFH

SEQ ID NO: 1386338 - protein, 9 aa, Homo Sapiens
IGPVGNLLV

SEQ ID NO: 1386339 - protein, 9 aa, Homo Sapiens
SSSKSFISS

SEQ ID NO: 1386340 - protein, 9 aa, Homo Sapiens
AGVQDGAAE

SEQ ID NO: 1386341 - protein, 9 aa, Homo Sapiens
ENLQKSANL

SEQ ID NO: 1386342 - protein, 9 aa, Homo Sapiens
LPVRSQTNA

SEQ ID NO: 1386343 - protein, 9 aa, Homo Sapiens
SVLVATVLM

SEQ ID NO: 1386344 - protein, 9 aa, Homo Sapiens
FIEGGADGS

SEQ ID NO: 1386345 - protein, 9 aa, Homo Sapiens
GPTPSPLTC

SEQ ID NO: 1386346 - protein, 9 aa, Homo Sapiens
STYITLKRI

SEQ ID NO: 1386347 - protein, 9 aa, Homo Sapiens
NLISALSRD

SEQ ID NO: 1386348 - protein, 9 aa, Homo Sapiens
MVVMIQTFP

SEQ ID NO: 1386349 - protein, 9 aa, Homo Sapiens
YQRRRGAGV

SEQ ID NO: 1386350 - protein, 9 aa, Homo Sapiens
MSPRALLTQ

SEQ ID NO: 1386351 - protein, 9 aa, Homo Sapiens
LLVTAKKPG

SEQ ID NO: 1386352 - protein, 9 aa, Homo Sapiens
AEAALSQTG

SEQ ID NO: 1386353 - protein, 9 aa, Homo Sapiens
TPATPQKSS

SEQ ID NO: 1386354 - protein, 9 aa, Homo Sapiens
WASAIAQDA

SEQ ID NO: 1386355 - protein, 9 aa, Homo Sapiens
VTPAQDGPC

SEQ ID NO: 1386356 - protein, 9 aa, Homo Sapiens
STIMSQRVC

SEQ ID NO: 1386357 - protein, 9 aa, Homo Sapiens
GGHSGSETG

SEQ ID NO: 1386358 - protein, 9 aa, Homo Sapiens
VTKIDAASP

SEQ ID NO: 1386359 - protein, 9 aa, Homo Sapiens
PAVLDSISH

SEQ ID NO: 1386360 - protein, 9 aa, Homo Sapiens
QTTQCLGLM

SEQ ID NO: 1386361 - protein, 9 aa, Homo Sapiens
DDEEAQGSG

SEQ ID NO: 1386362 - protein, 9 aa, Homo Sapiens
GVPACSHKV

SEQ ID NO: 1386363 - protein, 9 aa, Homo Sapiens
ELLVNMGGN

SEQ ID NO: 1386364 - protein, 9 aa, Homo Sapiens
AARAHQRTG

SEQ ID NO: 1386365 - protein, 9 aa, Homo Sapiens
DISSLNRMP

SEQ ID NO: 1386366 - protein, 9 aa, Homo Sapiens
LLEVIRCCQ

SEQ ID NO: 1386367 - protein, 9 aa, Homo Sapiens
LRGRGVARS

SEQ ID NO: 1386368 - protein, 9 aa, Homo Sapiens
DFGTYICVA

SEQ ID NO: 1386369 - protein, 9 aa, Homo Sapiens
MRGLRLIIP

SEQ ID NO: 1386370 - protein, 9 aa, Homo Sapiens
RSGMRDRSL

SEQ ID NO: 1386371 - protein, 9 aa, Homo Sapiens
DCANNVELT

SEQ ID NO: 1386372 - protein, 9 aa, Homo Sapiens
IKTKPTDTF

SEQ ID NO: 1386373 - protein, 9 aa, Homo Sapiens
GCHPAWLSP

SEQ ID NO: 1386374 - protein, 9 aa, Homo Sapiens
LLDKKNRVL

SEQ ID NO: 1386375 - protein, 9 aa, Homo Sapiens
LLWLGAHAW

SEQ ID NO: 1386376 - protein, 9 aa, Homo Sapiens
ISYSMNPQP

SEQ ID NO: 1386377 - protein, 9 aa, Homo Sapiens
LAMWEKGWD

SEQ ID NO: 1386378 - protein, 9 aa, Homo Sapiens
CDTDDDMAM

SEQ ID NO: 1386379 - protein, 9 aa, Homo Sapiens
FIQKNLCPA

SEQ ID NO: 1386380 - protein, 9 aa, Homo Sapiens
EDVKAKPIS

SEQ ID NO: 1386381 - protein, 9 aa, Homo Sapiens
CRRSSSAWA

SEQ ID NO: 1386382 - protein, 9 aa, Homo Sapiens
ESMTEEKFT

SEQ ID NO: 1386383 - protein, 9 aa, Homo Sapiens
EEVGAAGQE

SEQ ID NO: 1386384 - protein, 9 aa, Homo Sapiens
WTSAGEGPS

SEQ ID NO: 1386385 - protein, 9 aa, Homo Sapiens
PTLFPRPER

SEQ ID NO: 1386386 - protein, 9 aa, Homo Sapiens
VTFKSRNSY

SEQ ID NO: 1386387 - protein, 9 aa, Homo Sapiens
EKLHSEMEE

SEQ ID NO: 1386388 - protein, 9 aa, Homo Sapiens
NGLEQICPG

SEQ ID NO: 1386389 - protein, 9 aa, Homo Sapiens
TPEQMVPYG

SEQ ID NO: 1386390 - protein, 9 aa, Homo Sapiens
RRRLCQTQA

SEQ ID NO: 1386391 - protein, 9 aa, Homo Sapiens
NWLPARALV

SEQ ID NO: 1386392 - protein, 9 aa, Homo Sapiens
GAPAPPEWK

SEQ ID NO: 1386393 - protein, 9 aa, Homo Sapiens
QQWKRPMGL

SEQ ID NO: 1386394 - protein, 9 aa, Homo Sapiens
KGKRPQNPS

SEQ ID NO: 1386395 - protein, 9 aa, Homo Sapiens
LTPATPQKS

SEQ ID NO: 1386396 - protein, 9 aa, Homo Sapiens
VEGEAKRWE

SEQ ID NO: 1386397 - protein, 9 aa, Homo Sapiens
IPASHSDVG

SEQ ID NO: 1386398 - protein, 9 aa, Homo Sapiens
RRRNQSQNQ

SEQ ID NO: 1386399 - protein, 9 aa, Homo Sapiens
RFSSCRRDD

SEQ ID NO: 1386400 - protein, 9 aa, Homo Sapiens
AESMTEEKF

SEQ ID NO: 1386401 - protein, 9 aa, Homo Sapiens
NVEMVQQTT

SEQ ID NO: 1386402 - protein, 9 aa, Homo Sapiens
HYIRRHPGG

SEQ ID NO: 1386403 - protein, 9 aa, Homo Sapiens
SVAFSPSYL

SEQ ID NO: 1386404 - protein, 9 aa, Homo Sapiens
IIPVELLLC

SEQ ID NO: 1386405 - protein, 9 aa, Homo Sapiens
DGRNALWVA

SEQ ID NO: 1386406 - protein, 9 aa, Homo Sapiens
VPTGDQDRA

SEQ ID NO: 1386407 - protein, 9 aa, Homo Sapiens
SGDLGNGDF

SEQ ID NO: 1386408 - protein, 9 aa, Homo Sapiens
VLDSISHSR

SEQ ID NO: 1386409 - protein, 9 aa, Homo Sapiens
ATVQMVVMI

SEQ ID NO: 1386410 - protein, 9 aa, Homo Sapiens
YYEQKNSSR

SEQ ID NO: 1386411 - protein, 9 aa, Homo Sapiens
PENGLVAYE

SEQ ID NO: 1386412 - protein, 9 aa, Homo Sapiens
QVKKRKKRE

SEQ ID NO: 1386413 - protein, 9 aa, Homo Sapiens
LQRQLNTTL

SEQ ID NO: 1386414 - protein, 9 aa, Homo Sapiens
AATVQMVVM

SEQ ID NO: 1386415 - protein, 9 aa, Homo Sapiens
DMAMCFIKN

SEQ ID NO: 1386416 - protein, 9 aa, Homo Sapiens
GLCGATFET

SEQ ID NO: 1386417 - protein, 9 aa, Homo Sapiens
NYWIQAHRL

SEQ ID NO: 1386418 - protein, 9 aa, Homo Sapiens
SSHTQRQPW

SEQ ID NO: 1386419 - protein, 9 aa, Homo Sapiens
LVTRYQSKA

SEQ ID NO: 1386420 - protein, 9 aa, Homo Sapiens
EHFELDVVL

SEQ ID NO: 1386421 - protein, 9 aa, Homo Sapiens
AAPPPAPPA

SEQ ID NO: 1386422 - protein, 9 aa, Homo Sapiens
FFTFSLIVL

SEQ ID NO: 1386423 - protein, 9 aa, Homo Sapiens
DASKTLDSV

SEQ ID NO: 1386424 - protein, 9 aa, Homo Sapiens
LTFNNLTRL

SEQ ID NO: 1386425 - protein, 9 aa, Homo Sapiens
ERITTLEKH

SEQ ID NO: 1386426 - protein, 9 aa, Homo Sapiens
IFSTRNNLG

SEQ ID NO: 1386427 - protein, 9 aa, Homo Sapiens
SISFSDLPS

SEQ ID NO: 1386428 - protein, 9 aa, Homo Sapiens
STEEMEPSR

SEQ ID NO: 1386429 - protein, 9 aa, Homo Sapiens
GGANSDSSS

SEQ ID NO: 1386430 - protein, 9 aa, Homo Sapiens
HVCQDIPAS

SEQ ID NO: 1386431 - protein, 9 aa, Homo Sapiens
IFIPMTSHM

SEQ ID NO: 1386432 - protein, 9 aa, Homo Sapiens
GEVCTCQVR

SEQ ID NO: 1386433 - protein, 9 aa, Homo Sapiens
IFLIPSLSR

SEQ ID NO: 1386434 - protein, 9 aa, Homo Sapiens
GVNLGQGHP

SEQ ID NO: 1386435 - protein, 9 aa, Homo Sapiens
GIDDVFNFE

SEQ ID NO: 1386436 - protein, 9 aa, Homo Sapiens
ALAMWEKGW

SEQ ID NO: 1386437 - protein, 9 aa, Homo Sapiens
RFGLFHIDF

SEQ ID NO: 1386438 - protein, 9 aa, Homo Sapiens
IFGDLLREE

SEQ ID NO: 1386439 - protein, 9 aa, Homo Sapiens
ASWNLSQVG

SEQ ID NO: 1386440 - protein, 9 aa, Homo Sapiens
KSGKWGSSK

SEQ ID NO: 1386441 - protein, 9 aa, Homo Sapiens
AWLSPISAC

SEQ ID NO: 1386442 - protein, 9 aa, Homo Sapiens
NLDDRHWSM

SEQ ID NO: 1386443 - protein, 9 aa, Homo Sapiens
IACDALSSI

SEQ ID NO: 1386444 - protein, 9 aa, Homo Sapiens
PTCPRAYQS

SEQ ID NO: 1386445 - protein, 9 aa, Homo Sapiens
RIAEITDIK

SEQ ID NO: 1386446 - protein, 9 aa, Homo Sapiens
WLRNPDQSL

SEQ ID NO: 1386447 - protein, 9 aa, Homo Sapiens
NRRGSVLLF

SEQ ID NO: 1386448 - protein, 9 aa, Homo Sapiens
QEWLLAMLE

SEQ ID NO: 1386449 - protein, 9 aa, Homo Sapiens
QRFTSPKVT

SEQ ID NO: 1386450 - protein, 9 aa, Homo Sapiens
KVVLVTGQN

SEQ ID NO: 1386451 - protein, 9 aa, Homo Sapiens
AQDGARCPS

SEQ ID NO: 1386452 - protein, 9 aa, Homo Sapiens
RLMKRIAEI

SEQ ID NO: 1386453 - protein, 9 aa, Homo Sapiens
RQELPGKEL

SEQ ID NO: 1386454 - protein, 9 aa, Homo Sapiens
CTQGRRWGA

SEQ ID NO: 1386455 - protein, 9 aa, Homo Sapiens
KAEFEDSGT

SEQ ID NO: 1386456 - protein, 9 aa, Homo Sapiens
YLDSSAYES

SEQ ID NO: 1386457 - protein, 9 aa, Homo Sapiens
IERLTIRKE

SEQ ID NO: 1386458 - protein, 9 aa, Homo Sapiens
HCEEKGRCP

SEQ ID NO: 1386459 - protein, 9 aa, Homo Sapiens
LEGSAEIPT

SEQ ID NO: 1386460 - protein, 9 aa, Homo Sapiens
WPTSSCCSW

SEQ ID NO: 1386461 - protein, 9 aa, Homo Sapiens
PSYLPKQPD

SEQ ID NO: 1386462 - protein, 9 aa, Homo Sapiens
LDCANNVEL

SEQ ID NO: 1386463 - protein, 9 aa, Homo Sapiens
GLGAAQLLG

SEQ ID NO: 1386464 - protein, 9 aa, Homo Sapiens
SITTQDHQP

SEQ ID NO: 1386465 - protein, 9 aa, Homo Sapiens
RTQESTAKK

SEQ ID NO: 1386466 - protein, 9 aa, Homo Sapiens
SLCSTSLGW

SEQ ID NO: 1386467 - protein, 9 aa, Homo Sapiens
MVSEGGPEA

SEQ ID NO: 1386468 - protein, 9 aa, Homo Sapiens
NFSCFFSVE

SEQ ID NO: 1386469 - protein, 9 aa, Homo Sapiens
HFTTGRLMT

SEQ ID NO: 1386470 - protein, 9 aa, Homo Sapiens
MFITATGVV

SEQ ID NO: 1386471 - protein, 9 aa, Homo Sapiens
QVGGISPPF

SEQ ID NO: 1386472 - protein, 9 aa, Homo Sapiens
WLGAHAWLC

SEQ ID NO: 1386473 - protein, 9 aa, Homo Sapiens
DDVEIGMWN

SEQ ID NO: 1386474 - protein, 9 aa, Homo Sapiens
KLMGKYVNF

SEQ ID NO: 1386475 - protein, 9 aa, Homo Sapiens
TKKDIFGAS

SEQ ID NO: 1386476 - protein, 9 aa, Homo Sapiens
AWTLTMPPS

SEQ ID NO: 1386477 - protein, 9 aa, Homo Sapiens
ASGQGKKKP

SEQ ID NO: 1386478 - protein, 9 aa, Homo Sapiens
VKLHPHDKR

SEQ ID NO: 1386479 - protein, 9 aa, Homo Sapiens
PEGSCFPKN

SEQ ID NO: 1386480 - protein, 9 aa, Homo Sapiens
PEAPSTRAA

SEQ ID NO: 1386481 - protein, 9 aa, Homo Sapiens
NITQHSIPA

SEQ ID NO: 1386482 - protein, 9 aa, Homo Sapiens
GQHAAGKDV

SEQ ID NO: 1386483 - protein, 9 aa, Homo Sapiens
INYYESKIR

SEQ ID NO: 1386484 - protein, 9 aa, Homo Sapiens
RITIHWTCG

SEQ ID NO: 1386485 - protein, 9 aa, Homo Sapiens
HGMRKGAAM

SEQ ID NO: 1386486 - protein, 9 aa, Homo Sapiens
HLVILSPKS

SEQ ID NO: 1386487 - protein, 9 aa, Homo Sapiens
RGRGVARSE

SEQ ID NO: 1386488 - protein, 9 aa, Homo Sapiens
MWPGTDIPI

SEQ ID NO: 1386489 - protein, 9 aa, Homo Sapiens
PMTSRYNDG

SEQ ID NO: 1386490 - protein, 9 aa, Homo Sapiens
LRCPAVPAA

SEQ ID NO: 1386491 - protein, 9 aa, Homo Sapiens
DDNKPPIQM

SEQ ID NO: 1386492 - protein, 9 aa, Homo Sapiens
DSKGDESKI

SEQ ID NO: 1386493 - protein, 9 aa, Homo Sapiens
ARLALPATL

SEQ ID NO: 1386494 - protein, 9 aa, Homo Sapiens
KKICVRSAV

SEQ ID NO: 1386495 - protein, 9 aa, Homo Sapiens
ALHITSLAG

SEQ ID NO: 1386496 - protein, 9 aa, Homo Sapiens
WASSAPSSM

SEQ ID NO: 1386497 - protein, 9 aa, Homo Sapiens
IALKSSMEV

SEQ ID NO: 1386498 - protein, 9 aa, Homo Sapiens
VNGKKGALV

SEQ ID NO: 1386499 - protein, 9 aa, Homo Sapiens
AYRLQSECQ

SEQ ID NO: 1386500 - protein, 9 aa, Homo Sapiens
LHKTRPLVV

SEQ ID NO: 1386501 - protein, 9 aa, Homo Sapiens
FLLEGAGSR

SEQ ID NO: 1386502 - protein, 9 aa, Homo Sapiens
DGTDFPSCV

SEQ ID NO: 1386503 - protein, 9 aa, Homo Sapiens
SFSSTSSFE

SEQ ID NO: 1386504 - protein, 9 aa, Homo Sapiens
QQRVHHTDH

SEQ ID NO: 1386505 - protein, 9 aa, Homo Sapiens
VTFYSGDVI

SEQ ID NO: 1386506 - protein, 9 aa, Homo Sapiens
AYVRVGKGN

SEQ ID NO: 1386507 - protein, 9 aa, Homo Sapiens
SAISKVKLR

SEQ ID NO: 1386508 - protein, 9 aa, Homo Sapiens
FEQQEWLLA

SEQ ID NO: 1386509 - protein, 9 aa, Homo Sapiens
KDMLVNQPL

SEQ ID NO: 1386510 - protein, 9 aa, Homo Sapiens
LRPEVGGPG

SEQ ID NO: 1386511 - protein, 9 aa, Homo Sapiens
AEWCWGDIS

SEQ ID NO: 1386512 - protein, 9 aa, Homo Sapiens
LKHPLLSFK

SEQ ID NO: 1386513 - protein, 9 aa, Homo Sapiens
TCHWTIVPL

SEQ ID NO: 1386514 - protein, 9 aa, Homo Sapiens
PPFYSNSTV

SEQ ID NO: 1386515 - protein, 9 aa, Homo Sapiens
SFDSALHHR

SEQ ID NO: 1386516 - protein, 9 aa, Homo Sapiens
LHKLILDHN

SEQ ID NO: 1386517 - protein, 9 aa, Homo Sapiens
LASDGATWT

SEQ ID NO: 1386518 - protein, 9 aa, Homo Sapiens
AASLGGLRA

SEQ ID NO: 1386519 - protein, 9 aa, Homo Sapiens
TETRAPTPR

SEQ ID NO: 1386520 - protein, 9 aa, Homo Sapiens
NITATRTSP

SEQ ID NO: 1386521 - protein, 9 aa, Homo Sapiens
RCLRMRPPR

SEQ ID NO: 1386522 - protein, 9 aa, Homo Sapiens
TQRQPWVLR

SEQ ID NO: 1386523 - protein, 9 aa, Homo Sapiens
KHIIIPLER

SEQ ID NO: 1386524 - protein, 9 aa, Homo Sapiens
IPQNVRRIL

SEQ ID NO: 1386525 - protein, 9 aa, Homo Sapiens
EPLWKELSH

SEQ ID NO: 1386526 - protein, 9 aa, Homo Sapiens
EYNFFEMTI

SEQ ID NO: 1386527 - protein, 9 aa, Homo Sapiens
PLLESSTES

SEQ ID NO: 1386528 - protein, 9 aa, Homo Sapiens
SPIWHVQQL

SEQ ID NO: 1386529 - protein, 9 aa, Homo Sapiens
HDETAFFTN

SEQ ID NO: 1386530 - protein, 9 aa, Homo Sapiens
RAWSRLRGP

SEQ ID NO: 1386531 - protein, 9 aa, Homo Sapiens
PPECCSSWL

SEQ ID NO: 1386532 - protein, 9 aa, Homo Sapiens
NSTVSETQW

SEQ ID NO: 1386533 - protein, 9 aa, Homo Sapiens
VLRDGAGRY

SEQ ID NO: 1386534 - protein, 9 aa, Homo Sapiens
LLSPCNASI

SEQ ID NO: 1386535 - protein, 9 aa, Homo Sapiens
CGICKNHDQ

SEQ ID NO: 1386536 - protein, 9 aa, Homo Sapiens
CSITSIREK

SEQ ID NO: 1386537 - protein, 9 aa, Homo Sapiens
ANPLMKPAG

SEQ ID NO: 1386538 - protein, 9 aa, Homo Sapiens
MPSLARLLA

SEQ ID NO: 1386539 - protein, 9 aa, Homo Sapiens
KVLLMLGLL

SEQ ID NO: 1386540 - protein, 9 aa, Homo Sapiens
TRYQSKASD

SEQ ID NO: 1386541 - protein, 9 aa, Homo Sapiens
SVYIKPCYY

SEQ ID NO: 1386542 - protein, 9 aa, Homo Sapiens
AERSHGRER

SEQ ID NO: 1386543 - protein, 9 aa, Homo Sapiens
GQTTQCLGL

SEQ ID NO: 1386544 - protein, 9 aa, Homo Sapiens
SVVGMSPTL

SEQ ID NO: 1386545 - protein, 9 aa, Homo Sapiens
PALQPPGGC

SEQ ID NO: 1386546 - protein, 9 aa, Homo Sapiens
PPPPTKKRG

SEQ ID NO: 1386547 - protein, 9 aa, Homo Sapiens
QSAPSAPVS

SEQ ID NO: 1386548 - protein, 9 aa, Homo Sapiens
TDTFLQILR

SEQ ID NO: 1386549 - protein, 9 aa, Homo Sapiens
GLSYKEDMK

SEQ ID NO: 1386550 - protein, 9 aa, Homo Sapiens
ALVSWKQSQ

SEQ ID NO: 1386551 - protein, 9 aa, Homo Sapiens
RVKALKKKP

SEQ ID NO: 1386552 - protein, 9 aa, Homo Sapiens
VYIKPCYYS

SEQ ID NO: 1386553 - protein, 9 aa, Homo Sapiens
NVGLLGAGP

SEQ ID NO: 1386554 - protein, 9 aa, Homo Sapiens
IVPLTMGWP

SEQ ID NO: 1386555 - protein, 9 aa, Homo Sapiens
YVRLSAVGL

SEQ ID NO: 1386556 - protein, 9 aa, Homo Sapiens
VVSGIDLTK

SEQ ID NO: 1386557 - protein, 9 aa, Homo Sapiens
RMRQVRCPA

SEQ ID NO: 1386558 - protein, 9 aa, Homo Sapiens
GLCLPMIVG

SEQ ID NO: 1386559 - protein, 9 aa, Homo Sapiens
CGEGTTVSY

SEQ ID NO: 1386560 - protein, 9 aa, Homo Sapiens
EDLTSQEIL

SEQ ID NO: 1386561 - protein, 9 aa, Homo Sapiens
RAPSSPASM

SEQ ID NO: 1386562 - protein, 9 aa, Homo Sapiens
TEDVRVQEV

SEQ ID NO: 1386563 - protein, 9 aa, Homo Sapiens
ILSCVATGS

SEQ ID NO: 1386564 - protein, 9 aa, Homo Sapiens
PVWYNIIGP

SEQ ID NO: 1386565 - protein, 9 aa, Homo Sapiens
GPCASLLST

SEQ ID NO: 1386566 - protein, 9 aa, Homo Sapiens
KLLWDRIVL

SEQ ID NO: 1386567 - protein, 9 aa, Homo Sapiens
DLTKKDIFG

SEQ ID NO: 1386568 - protein, 9 aa, Homo Sapiens
TFCATLLAF

SEQ ID NO: 1386569 - protein, 9 aa, Homo Sapiens
AEFQHLQLK

SEQ ID NO: 1386570 - protein, 9 aa, Homo Sapiens
AVGLSTWSA

SEQ ID NO: 1386571 - protein, 9 aa, Homo Sapiens
PGSQQQLYR

SEQ ID NO: 1386572 - protein, 9 aa, Homo Sapiens
EGVHGPGPC

SEQ ID NO: 1386573 - protein, 9 aa, Homo Sapiens
QEEDFHLQN

SEQ ID NO: 1386574 - protein, 9 aa, Homo Sapiens
KLRRKNNFR

SEQ ID NO: 1386575 - protein, 9 aa, Homo Sapiens
EAALWCGHE

SEQ ID NO: 1386576 - protein, 9 aa, Homo Sapiens
ATPDSSAPH

SEQ ID NO: 1386577 - protein, 9 aa, Homo Sapiens
ELIERLNNP

SEQ ID NO: 1386578 - protein, 9 aa, Homo Sapiens
STQTTATCS

SEQ ID NO: 1386579 - protein, 9 aa, Homo Sapiens
RVSEEIFGR

SEQ ID NO: 1386580 - protein, 9 aa, Homo Sapiens
PQEQKQAPS

SEQ ID NO: 1386581 - protein, 9 aa, Homo Sapiens
TRSLVLRFK

SEQ ID NO: 1386582 - protein, 9 aa, Homo Sapiens
CPSPPWSPS

SEQ ID NO: 1386583 - protein, 9 aa, Homo Sapiens
QKQAPSTRR

SEQ ID NO: 1386584 - protein, 9 aa, Homo Sapiens
GATWTDIFK

SEQ ID NO: 1386585 - protein, 9 aa, Homo Sapiens
PAAWKKRFA

SEQ ID NO: 1386586 - protein, 9 aa, Homo Sapiens
RLDIEVQIG

SEQ ID NO: 1386587 - protein, 9 aa, Homo Sapiens
QQTRKTCIR

SEQ ID NO: 1386588 - protein, 9 aa, Homo Sapiens
HLAKPFSQL

SEQ ID NO: 1386589 - protein, 9 aa, Homo Sapiens
ANSDSSSPN

SEQ ID NO: 1386590 - protein, 9 aa, Homo Sapiens
LEHYVLYMS

SEQ ID NO: 1386591 - protein, 9 aa, Homo Sapiens
PPIFGDLLR

SEQ ID NO: 1386592 - protein, 9 aa, Homo Sapiens
RKKLSDTPK

SEQ ID NO: 1386593 - protein, 9 aa, Homo Sapiens
SPCNASIMC

SEQ ID NO: 1386594 - protein, 9 aa, Homo Sapiens
IELRIKRKK

SEQ ID NO: 1386595 - protein, 9 aa, Homo Sapiens
WPAVPSSCT

SEQ ID NO: 1386596 - protein, 9 aa, Homo Sapiens
HFRVLQHLS

SEQ ID NO: 1386597 - protein, 9 aa, Homo Sapiens
PLSPCRWLK

SEQ ID NO: 1386598 - protein, 9 aa, Homo Sapiens
YTHIYIHTH

SEQ ID NO: 1386599 - protein, 9 aa, Homo Sapiens
QHSITTQDH

SEQ ID NO: 1386600 - protein, 9 aa, Homo Sapiens
EVGRLGGVL

SEQ ID NO: 1386601 - protein, 9 aa, Homo Sapiens
ALTLGATSA

SEQ ID NO: 1386602 - protein, 9 aa, Homo Sapiens
KRGEKGERG

SEQ ID NO: 1386603 - protein, 9 aa, Homo Sapiens
DGDYQTGFP

SEQ ID NO: 1386604 - protein, 9 aa, Homo Sapiens
HVQVGGISP

SEQ ID NO: 1386605 - protein, 9 aa, Homo Sapiens
HGIQRVEAM

SEQ ID NO: 1386606 - protein, 9 aa, Homo Sapiens
RQPLHAVHH

SEQ ID NO: 1386607 - protein, 9 aa, Homo Sapiens
DEKRGSRSK

SEQ ID NO: 1386608 - protein, 9 aa, Homo Sapiens
KCQKRAPIN

SEQ ID NO: 1386609 - protein, 9 aa, Homo Sapiens
YLVLTLTKM

SEQ ID NO: 1386610 - protein, 9 aa, Homo Sapiens
RPLVLTVLD

SEQ ID NO: 1386611 - protein, 9 aa, Homo Sapiens
SHHEFFMPE

SEQ ID NO: 1386612 - protein, 9 aa, Homo Sapiens
HKSALLGKK

SEQ ID NO: 1386613 - protein, 9 aa, Homo Sapiens
ELPACAQWS

SEQ ID NO: 1386614 - protein, 9 aa, Homo Sapiens
ETKKKRNRR

SEQ ID NO: 1386615 - protein, 9 aa, Homo Sapiens
GLEHQHSLK

SEQ ID NO: 1386616 - protein, 9 aa, Homo Sapiens
LSLYSVAVW

SEQ ID NO: 1386617 - protein, 9 aa, Homo Sapiens
VGSPIWHVQ

SEQ ID NO: 1386618 - protein, 9 aa, Homo Sapiens
GTLTIYDAW

SEQ ID NO: 1386619 - protein, 9 aa, Homo Sapiens
ASPTTHLQA

SEQ ID NO: 1386620 - protein, 9 aa, Homo Sapiens
RCAIWLAEQ

SEQ ID NO: 1386621 - protein, 9 aa, Homo Sapiens
RLGAGAGGR

SEQ ID NO: 1386622 - protein, 9 aa, Homo Sapiens
TRARGPPSR

SEQ ID NO: 1386623 - protein, 9 aa, Homo Sapiens
LGLPGPKGF

SEQ ID NO: 1386624 - protein, 9 aa, Homo Sapiens
YQLFKELGK

SEQ ID NO: 1386625 - protein, 9 aa, Homo Sapiens
IEFEKLSAG

SEQ ID NO: 1386626 - protein, 9 aa, Homo Sapiens
PWPTHLPSA

SEQ ID NO: 1386627 - protein, 9 aa, Homo Sapiens
EWKCSPLSL

SEQ ID NO: 1386628 - protein, 9 aa, Homo Sapiens
EAYSSPSTT

SEQ ID NO: 1386629 - protein, 9 aa, Homo Sapiens
KREVGIDDV

SEQ ID NO: 1386630 - protein, 9 aa, Homo Sapiens
LRSIMSGDR

SEQ ID NO: 1386631 - protein, 9 aa, Homo Sapiens
KLNLSTILI

SEQ ID NO: 1386632 - protein, 9 aa, Homo Sapiens
SAPAAAPPP

SEQ ID NO: 1386633 - protein, 9 aa, Homo Sapiens
KFHEMVTFK

SEQ ID NO: 1386634 - protein, 9 aa, Homo Sapiens
LPLPPAMKH

SEQ ID NO: 1386635 - protein, 9 aa, Homo Sapiens
NFLKHKLNS

SEQ ID NO: 1386636 - protein, 9 aa, Homo Sapiens
VSEEIFGRI

SEQ ID NO: 1386637 - protein, 9 aa, Homo Sapiens
DFYQHNWLP

SEQ ID NO: 1386638 - protein, 9 aa, Homo Sapiens
ALWVAALEG

SEQ ID NO: 1386639 - protein, 9 aa, Homo Sapiens
SQLDAANLE

SEQ ID NO: 1386640 - protein, 9 aa, Homo Sapiens
TEDLTSQEI

SEQ ID NO: 1386641 - protein, 9 aa, Homo Sapiens
DAEWCWGDI

SEQ ID NO: 1386642 - protein, 9 aa, Homo Sapiens
QEQKQAPST

SEQ ID NO: 1386643 - protein, 9 aa, Homo Sapiens
MSNRHVCRH

SEQ ID NO: 1386644 - protein, 9 aa, Homo Sapiens
GVQSATVQA

SEQ ID NO: 1386645 - protein, 9 aa, Homo Sapiens
GPEDGVNPA

SEQ ID NO: 1386646 - protein, 9 aa, Homo Sapiens
LGMCLTSSM

SEQ ID NO: 1386647 - protein, 9 aa, Homo Sapiens
PTHLPSAPA

SEQ ID NO: 1386648 - protein, 9 aa, Homo Sapiens
ISVTLGDEV

SEQ ID NO: 1386649 - protein, 9 aa, Homo Sapiens
WDTIIFSCF

SEQ ID NO: 1386650 - protein, 9 aa, Homo Sapiens
RLRRRSRSH

SEQ ID NO: 1386651 - protein, 9 aa, Homo Sapiens
SLETGAPLP

SEQ ID NO: 1386652 - protein, 9 aa, Homo Sapiens
NDTTLQELL

SEQ ID NO: 1386653 - protein, 9 aa, Homo Sapiens
ISFSDLPSG

SEQ ID NO: 1386654 - protein, 9 aa, Homo Sapiens
SPGIGSLLP

SEQ ID NO: 1386655 - protein, 9 aa, Homo Sapiens
EHQKKLNLS

SEQ ID NO: 1386656 - protein, 9 aa, Homo Sapiens
FEVVLQNLF

SEQ ID NO: 1386657 - protein, 9 aa, Homo Sapiens
EKKPEEEEE

SEQ ID NO: 1386658 - protein, 9 aa, Homo Sapiens
RSKNFCLKI

SEQ ID NO: 1386659 - protein, 9 aa, Homo Sapiens
LVVMSFDRY

SEQ ID NO: 1386660 - protein, 9 aa, Homo Sapiens
KNVLENLQK

SEQ ID NO: 1386661 - protein, 9 aa, Homo Sapiens
DLRGRGVAR

SEQ ID NO: 1386662 - protein, 9 aa, Homo Sapiens
LQTEGGFWK

SEQ ID NO: 1386663 - protein, 9 aa, Homo Sapiens
STQVSPTRN

SEQ ID NO: 1386664 - protein, 9 aa, Homo Sapiens
GWLERAYGR

SEQ ID NO: 1386665 - protein, 9 aa, Homo Sapiens
DLVIFHFPL

SEQ ID NO: 1386666 - protein, 9 aa, Homo Sapiens
IVCGVWYMP

SEQ ID NO: 1386667 - protein, 9 aa, Homo Sapiens
LIPECFNET

SEQ ID NO: 1386668 - protein, 9 aa, Homo Sapiens
PKRQKRQLW

SEQ ID NO: 1386669 - protein, 9 aa, Homo Sapiens
VTLITIWVY

SEQ ID NO: 1386670 - protein, 9 aa, Homo Sapiens
SQARLSARM

SEQ ID NO: 1386671 - protein, 9 aa, Homo Sapiens
MVHLVKISC

SEQ ID NO: 1386672 - protein, 9 aa, Homo Sapiens
AIESLDGIT

SEQ ID NO: 1386673 - protein, 9 aa, Homo Sapiens
EPPEDSPPR

SEQ ID NO: 1386674 - protein, 9 aa, Homo Sapiens
TSHLEGTAY

SEQ ID NO: 1386675 - protein, 9 aa, Homo Sapiens
GTDIPIHDT

SEQ ID NO: 1386676 - protein, 9 aa, Homo Sapiens
PGIRGALTT

SEQ ID NO: 1386677 - protein, 9 aa, Homo Sapiens
EEFRDLLKV

SEQ ID NO: 1386678 - protein, 9 aa, Homo Sapiens
WTAATLRCP

SEQ ID NO: 1386679 - protein, 9 aa, Homo Sapiens
LSILQHAAD

SEQ ID NO: 1386680 - protein, 9 aa, Homo Sapiens
YIYTHIYIH

SEQ ID NO: 1386681 - protein, 9 aa, Homo Sapiens
EFSGESKEQ

SEQ ID NO: 1386682 - protein, 9 aa, Homo Sapiens
SVLKHPLLS

SEQ ID NO: 1386683 - protein, 9 aa, Homo Sapiens
GRHPSWPWT

SEQ ID NO: 1386684 - protein, 9 aa, Homo Sapiens
ALVTRYQSK

SEQ ID NO: 1386685 - protein, 9 aa, Homo Sapiens
DGRHVLDGL

SEQ ID NO: 1386686 - protein, 9 aa, Homo Sapiens
PCTSAVSAP

SEQ ID NO: 1386687 - protein, 9 aa, Homo Sapiens
AQDGPCGTV

SEQ ID NO: 1386688 - protein, 9 aa, Homo Sapiens
QQLYRPLVL

SEQ ID NO: 1386689 - protein, 9 aa, Homo Sapiens
TFGGNITQH

SEQ ID NO: 1386690 - protein, 9 aa, Homo Sapiens
LVTSETSYY

SEQ ID NO: 1386691 - protein, 9 aa, Homo Sapiens
MIISLPTKM

SEQ ID NO: 1386692 - protein, 9 aa, Homo Sapiens
HPGSWPVAQ

SEQ ID NO: 1386693 - protein, 9 aa, Homo Sapiens
GDHSTDKNG

SEQ ID NO: 1386694 - protein, 9 aa, Homo Sapiens
ILEKIEHDD

SEQ ID NO: 1386695 - protein, 9 aa, Homo Sapiens
LDGGSNRGD

SEQ ID NO: 1386696 - protein, 9 aa, Homo Sapiens
INENVINVQ

SEQ ID NO: 1386697 - protein, 9 aa, Homo Sapiens
VCHVDATGQ

SEQ ID NO: 1386698 - protein, 9 aa, Homo Sapiens
PVRKPHPGQ

SEQ ID NO: 1386699 - protein, 9 aa, Homo Sapiens
PSEEELPNL

SEQ ID NO: 1386700 - protein, 9 aa, Homo Sapiens
FPPRVECLE

SEQ ID NO: 1386701 - protein, 9 aa, Homo Sapiens
GSVGEWLQA

SEQ ID NO: 1386702 - protein, 9 aa, Homo Sapiens
EQHGIQRVE

SEQ ID NO: 1386703 - protein, 9 aa, Homo Sapiens
NLGFTPADT

SEQ ID NO: 1386704 - protein, 9 aa, Homo Sapiens
AMSVLYHIA

SEQ ID NO: 1386705 - protein, 9 aa, Homo Sapiens
ENSERKGLP

SEQ ID NO: 1386706 - protein, 9 aa, Homo Sapiens
VSCCYVRLS

SEQ ID NO: 1386707 - protein, 9 aa, Homo Sapiens
FSFAFSFPW

SEQ ID NO: 1386708 - protein, 9 aa, Homo Sapiens
SQLKVMDRQ

SEQ ID NO: 1386709 - protein, 9 aa, Homo Sapiens
LSEDVQAAL

SEQ ID NO: 1386710 - protein, 9 aa, Homo Sapiens
QSQLKVMDR

SEQ ID NO: 1386711 - protein, 9 aa, Homo Sapiens
PDAVVASSS

SEQ ID NO: 1386712 - protein, 9 aa, Homo Sapiens
AMKILHKAD

SEQ ID NO: 1386713 - protein, 9 aa, Homo Sapiens
LGATSAAGA

SEQ ID NO: 1386714 - protein, 9 aa, Homo Sapiens
PERVFTLAR

SEQ ID NO: 1386715 - protein, 9 aa, Homo Sapiens
DMATSQVTS

SEQ ID NO: 1386716 - protein, 9 aa, Homo Sapiens
RAPHVCQDI

SEQ ID NO: 1386717 - protein, 9 aa, Homo Sapiens
KGLPFHVDN

SEQ ID NO: 1386718 - protein, 9 aa, Homo Sapiens
LIMNTSTED

SEQ ID NO: 1386719 - protein, 9 aa, Homo Sapiens
MKRRISSSV

SEQ ID NO: 1386720 - protein, 9 aa, Homo Sapiens
TMDPGPGAW

SEQ ID NO: 1386721 - protein, 9 aa, Homo Sapiens
HILSSCCKM

SEQ ID NO: 1386722 - protein, 9 aa, Homo Sapiens
KEHLLSSNS

SEQ ID NO: 1386723 - protein, 9 aa, Homo Sapiens
KKCHEKSTG

SEQ ID NO: 1386724 - protein, 9 aa, Homo Sapiens
RDLNYLRVL

SEQ ID NO: 1386725 - protein, 9 aa, Homo Sapiens
TWMRPKKCP

SEQ ID NO: 1386726 - protein, 9 aa, Homo Sapiens
PPGAGEEGP

SEQ ID NO: 1386727 - protein, 9 aa, Homo Sapiens
PATTAETQD

SEQ ID NO: 1386728 - protein, 9 aa, Homo Sapiens
MSVLYHIAQ

SEQ ID NO: 1386729 - protein, 9 aa, Homo Sapiens
TQGMLMAGS

SEQ ID NO: 1386730 - protein, 9 aa, Homo Sapiens
KCHEKSTGL

SEQ ID NO: 1386731 - protein, 9 aa, Homo Sapiens
GYLCCALWG

SEQ ID NO: 1386732 - protein, 9 aa, Homo Sapiens
HPERIHLHH

SEQ ID NO: 1386733 - protein, 9 aa, Homo Sapiens
DLVLKGKRS

SEQ ID NO: 1386734 - protein, 9 aa, Homo Sapiens
PPPRPPSHN

SEQ ID NO: 1386735 - protein, 9 aa, Homo Sapiens
RGRAGPAAA

SEQ ID NO: 1386736 - protein, 9 aa, Homo Sapiens
KEEEDDDDD

SEQ ID NO: 1386737 - protein, 9 aa, Homo Sapiens
QQQSQQQPP

SEQ ID NO: 1386738 - protein, 9 aa, Homo Sapiens
ALPPVTSQE

SEQ ID NO: 1386739 - protein, 9 aa, Homo Sapiens
IEDIVCDGR

SEQ ID NO: 1386740 - protein, 9 aa, Homo Sapiens
PGGEDQRLC

SEQ ID NO: 1386741 - protein, 9 aa, Homo Sapiens
LCLLCPGET

SEQ ID NO: 1386742 - protein, 9 aa, Homo Sapiens
QFAVVKKCH

SEQ ID NO: 1386743 - protein, 9 aa, Homo Sapiens
KKRVNTAWK

SEQ ID NO: 1386744 - protein, 9 aa, Homo Sapiens
LAEEQSEIE

SEQ ID NO: 1386745 - protein, 9 aa, Homo Sapiens
ANLISALSR

SEQ ID NO: 1386746 - protein, 9 aa, Homo Sapiens
TTGPCPAPA

SEQ ID NO: 1386747 - protein, 9 aa, Homo Sapiens
KLHSEMEEE

SEQ ID NO: 1386748 - protein, 9 aa, Homo Sapiens
RGVFLFTDT

SEQ ID NO: 1386749 - protein, 9 aa, Homo Sapiens
HFELDVVLE

SEQ ID NO: 1386750 - protein, 9 aa, Homo Sapiens
PTQYIAVRT

SEQ ID NO: 1386751 - protein, 9 aa, Homo Sapiens
LILKGLEEN

SEQ ID NO: 1386752 - protein, 9 aa, Homo Sapiens
RGPAAPTSW

SEQ ID NO: 1386753 - protein, 9 aa, Homo Sapiens
LAATVQMVV

SEQ ID NO: 1386754 - protein, 9 aa, Homo Sapiens
PGMDTALGW

SEQ ID NO: 1386755 - protein, 9 aa, Homo Sapiens
DFLLVFSAV

SEQ ID NO: 1386756 - protein, 9 aa, Homo Sapiens
PVTSTWMTC

SEQ ID NO: 1386757 - protein, 9 aa, Homo Sapiens
VEYAEEEKK

SEQ ID NO: 1386758 - protein, 9 aa, Homo Sapiens
RAAAEAALS

SEQ ID NO: 1386759 - protein, 9 aa, Homo Sapiens
SAIAIKLGS

SEQ ID NO: 1386760 - protein, 9 aa, Homo Sapiens
FGLFHIDFE

SEQ ID NO: 1386761 - protein, 9 aa, Homo Sapiens
AEEAAASRL

SEQ ID NO: 1386762 - protein, 9 aa, Homo Sapiens
AAQTRWWRG

SEQ ID NO: 1386763 - protein, 9 aa, Homo Sapiens
CSTPPCWWT

SEQ ID NO: 1386764 - protein, 9 aa, Homo Sapiens
DIDRMLQEA

SEQ ID NO: 1386765 - protein, 9 aa, Homo Sapiens
ERRSPQAHK

SEQ ID NO: 1386766 - protein, 9 aa, Homo Sapiens
CTVAVPKGE

SEQ ID NO: 1386767 - protein, 9 aa, Homo Sapiens
QQLEYTACL

SEQ ID NO: 1386768 - protein, 9 aa, Homo Sapiens
PLLLEVIRC

SEQ ID NO: 1386769 - protein, 9 aa, Homo Sapiens
PSGRWTTRP

SEQ ID NO: 1386770 - protein, 9 aa, Homo Sapiens
NMFITATGV

SEQ ID NO: 1386771 - protein, 9 aa, Homo Sapiens
SVLQRVLYR

SEQ ID NO: 1386772 - protein, 9 aa, Homo Sapiens
QMELPACAQ

SEQ ID NO: 1386773 - protein, 9 aa, Homo Sapiens
WTTRPCRRS

SEQ ID NO: 1386774 - protein, 9 aa, Homo Sapiens
RNVAKDGRL

SEQ ID NO: 1386775 - protein, 9 aa, Homo Sapiens
SLQRQLNTT

SEQ ID NO: 1386776 - protein, 9 aa, Homo Sapiens
QSPPMDLPG

SEQ ID NO: 1386777 - protein, 9 aa, Homo Sapiens
ALSHGPLGD

SEQ ID NO: 1386778 - protein, 9 aa, Homo Sapiens
RQSNQSLLS

SEQ ID NO: 1386779 - protein, 9 aa, Homo Sapiens
LVLKGKRSH

SEQ ID NO: 1386780 - protein, 9 aa, Homo Sapiens
EVYKRAKVL

SEQ ID NO: 1386781 - protein, 9 aa, Homo Sapiens
RSIMSGDRD

SEQ ID NO: 1386782 - protein, 9 aa, Homo Sapiens
EKAMLMAVD

SEQ ID NO: 1386783 - protein, 9 aa, Homo Sapiens
MDLPGLTRE

SEQ ID NO: 1386784 - protein, 9 aa, Homo Sapiens
DLHPNTKYH

SEQ ID NO: 1386785 - protein, 9 aa, Homo Sapiens
CLKIYDMEH

SEQ ID NO: 1386786 - protein, 9 aa, Homo Sapiens
LRSGMRDRS

SEQ ID NO: 1386787 - protein, 9 aa, Homo Sapiens
SCTLDQICL

SEQ ID NO: 1386788 - protein, 9 aa, Homo Sapiens
EFEDSGTET

SEQ ID NO: 1386789 - protein, 9 aa, Homo Sapiens
RNRIQRCIA

SEQ ID NO: 1386790 - protein, 9 aa, Homo Sapiens
TVQMVVMIQ

SEQ ID NO: 1386791 - protein, 9 aa, Homo Sapiens
IKGLLGLPG

SEQ ID NO: 1386792 - protein, 9 aa, Homo Sapiens
LSEGLFQHL

SEQ ID NO: 1386793 - protein, 9 aa, Homo Sapiens
VLLWELVTW

SEQ ID NO: 1386794 - protein, 9 aa, Homo Sapiens
GPGLGAAQL

SEQ ID NO: 1386795 - protein, 9 aa, Homo Sapiens
VQSATVQAF

SEQ ID NO: 1386796 - protein, 9 aa, Homo Sapiens
NQSQNQRGL

SEQ ID NO: 1386797 - protein, 9 aa, Homo Sapiens
TSSHTNSSV

SEQ ID NO: 1386798 - protein, 9 aa, Homo Sapiens
QLDAANLEK

SEQ ID NO: 1386799 - protein, 9 aa, Homo Sapiens
CPLLLVYIM

SEQ ID NO: 1386800 - protein, 9 aa, Homo Sapiens
RSNAYFYGF

SEQ ID NO: 1386801 - protein, 9 aa, Homo Sapiens
YHCDMYVKV

SEQ ID NO: 1386802 - protein, 9 aa, Homo Sapiens
ITSIREKPQ

SEQ ID NO: 1386803 - protein, 9 aa, Homo Sapiens
VDPEARAPT

SEQ ID NO: 1386804 - protein, 9 aa, Homo Sapiens
TIECLKRHN

SEQ ID NO: 1386805 - protein, 9 aa, Homo Sapiens
GKRKEWQRQ

SEQ ID NO: 1386806 - protein, 9 aa, Homo Sapiens
PKSRGPAAW

SEQ ID NO: 1386807 - protein, 9 aa, Homo Sapiens
HLLDGGSNR

SEQ ID NO: 1386808 - protein, 9 aa, Homo Sapiens
AKPFSQLYI

SEQ ID NO: 1386809 - protein, 9 aa, Homo Sapiens
EEMVKNVLE

SEQ ID NO: 1386810 - protein, 9 aa, Homo Sapiens
FTFASTYIT

SEQ ID NO: 1386811 - protein, 9 aa, Homo Sapiens
NMNAMSVLY

SEQ ID NO: 1386812 - protein, 9 aa, Homo Sapiens
VPVAHCFAP

SEQ ID NO: 1386813 - protein, 9 aa, Homo Sapiens
LHHRLCPAS

SEQ ID NO: 1386814 - protein, 9 aa, Homo Sapiens
KKPLYENLR

SEQ ID NO: 1386815 - protein, 9 aa, Homo Sapiens
ALPLQLLWL

SEQ ID NO: 1386816 - protein, 9 aa, Homo Sapiens
SACPRLLPY

SEQ ID NO: 1386817 - protein, 9 aa, Homo Sapiens
PLASQAISA

SEQ ID NO: 1386818 - protein, 9 aa, Homo Sapiens
SSHYSQMDQ

SEQ ID NO: 1386819 - protein, 9 aa, Homo Sapiens
SQVHSPCIN

SEQ ID NO: 1386820 - protein, 9 aa, Homo Sapiens
LHHPERIHL

SEQ ID NO: 1386821 - protein, 9 aa, Homo Sapiens
PWGTLSIAY

SEQ ID NO: 1386822 - protein, 9 aa, Homo Sapiens
QDVQMKGEF

SEQ ID NO: 1386823 - protein, 9 aa, Homo Sapiens
EAGYKQEVA

SEQ ID NO: 1386824 - protein, 9 aa, Homo Sapiens
SLAAMQPVQ

SEQ ID NO: 1386825 - protein, 9 aa, Homo Sapiens
FPQNAIRQH

SEQ ID NO: 1386826 - protein, 9 aa, Homo Sapiens
TANITATRT

SEQ ID NO: 1386827 - protein, 9 aa, Homo Sapiens
QQEWLLAML

SEQ ID NO: 1386828 - protein, 9 aa, Homo Sapiens
SVEHRDNLV

SEQ ID NO: 1386829 - protein, 9 aa, Homo Sapiens
MVGCLAWLI

SEQ ID NO: 1386830 - protein, 9 aa, Homo Sapiens
SMFFSQSLI

SEQ ID NO: 1386831 - protein, 9 aa, Homo Sapiens
HIKRPVNAF

SEQ ID NO: 1386832 - protein, 9 aa, Homo Sapiens
GQGSIISTQ

SEQ ID NO: 1386833 - protein, 9 aa, Homo Sapiens
GLLIEVSEE

SEQ ID NO: 1386834 - protein, 9 aa, Homo Sapiens
LSCMGGGLA

SEQ ID NO: 1386835 - protein, 9 aa, Homo Sapiens
GFWLSLLYW

SEQ ID NO: 1386836 - protein, 9 aa, Homo Sapiens
DYDVEKNNS

SEQ ID NO: 1386837 - protein, 9 aa, Homo Sapiens
SFLQCLTEY

SEQ ID NO: 1386838 - protein, 9 aa, Homo Sapiens
GPAAPTSWA

SEQ ID NO: 1386839 - protein, 9 aa, Homo Sapiens
CSWSCWSAS

SEQ ID NO: 1386840 - protein, 9 aa, Homo Sapiens
VVEPYAFRD

SEQ ID NO: 1386841 - protein, 9 aa, Homo Sapiens
LEHQHSLKK

SEQ ID NO: 1386842 - protein, 9 aa, Homo Sapiens
QHNWLPARA

SEQ ID NO: 1386843 - protein, 9 aa, Homo Sapiens
RDPQLAWVS

SEQ ID NO: 1386844 - protein, 9 aa, Homo Sapiens
CKLMGKYVN

SEQ ID NO: 1386845 - protein, 9 aa, Homo Sapiens
SFVGQISTL

SEQ ID NO: 1386846 - protein, 9 aa, Homo Sapiens
VTLGWGPED

SEQ ID NO: 1386847 - protein, 9 aa, Homo Sapiens
QQFRNCILQ

SEQ ID NO: 1386848 - protein, 9 aa, Homo Sapiens
SLDRGCNWT

SEQ ID NO: 1386849 - protein, 9 aa, Homo Sapiens
MYDTVQRTG

SEQ ID NO: 1386850 - protein, 9 aa, Homo Sapiens
ATSSSCSTP

SEQ ID NO: 1386851 - protein, 9 aa, Homo Sapiens
LLTRQDVQS

SEQ ID NO: 1386852 - protein, 9 aa, Homo Sapiens
VAGSLAAMQ

SEQ ID NO: 1386853 - protein, 9 aa, Homo Sapiens
NSPMAANRT

SEQ ID NO: 1386854 - protein, 9 aa, Homo Sapiens
AHCKVLMRV

SEQ ID NO: 1386855 - protein, 9 aa, Homo Sapiens
FLELFHCLN

SEQ ID NO: 1386856 - protein, 9 aa, Homo Sapiens
FTSPKVTLG

SEQ ID NO: 1386857 - protein, 9 aa, Homo Sapiens
ARTTASALT

SEQ ID NO: 1386858 - protein, 9 aa, Homo Sapiens
FKKRPQRKG

SEQ ID NO: 1386859 - protein, 9 aa, Homo Sapiens
NASIMCPLN

SEQ ID NO: 1386860 - protein, 9 aa, Homo Sapiens
INTPEQMVP

SEQ ID NO: 1386861 - protein, 9 aa, Homo Sapiens
WRLGFLEPG

SEQ ID NO: 1386862 - protein, 9 aa, Homo Sapiens
LPCTLLPKD

SEQ ID NO: 1386863 - protein, 9 aa, Homo Sapiens
KEVLKKQLF

SEQ ID NO: 1386864 - protein, 9 aa, Homo Sapiens
ARALPRRLG

SEQ ID NO: 1386865 - protein, 9 aa, Homo Sapiens
TRCCRPRTR

SEQ ID NO: 1386866 - protein, 9 aa, Homo Sapiens
AGSRVCLAN

SEQ ID NO: 1386867 - protein, 9 aa, Homo Sapiens
SEEEGKRKE

SEQ ID NO: 1386868 - protein, 9 aa, Homo Sapiens
ILPGSQQQL

SEQ ID NO: 1386869 - protein, 9 aa, Homo Sapiens
SNMLPVRSQ

SEQ ID NO: 1386870 - protein, 9 aa, Homo Sapiens
FYHTGGSHC

SEQ ID NO: 1386871 - protein, 9 aa, Homo Sapiens
VYVTSQQIF

SEQ ID NO: 1386872 - protein, 9 aa, Homo Sapiens
HWTIVPLTM

SEQ ID NO: 1386873 - protein, 9 aa, Homo Sapiens
ECQKTVPPE

SEQ ID NO: 1386874 - protein, 9 aa, Homo Sapiens
TLLVSQVII

SEQ ID NO: 1386875 - protein, 9 aa, Homo Sapiens
TGRPASASP

SEQ ID NO: 1386876 - protein, 9 aa, Homo Sapiens
EEGKRKEWQ

SEQ ID NO: 1386877 - protein, 9 aa, Homo Sapiens
LHGMRKGAA

SEQ ID NO: 1386878 - protein, 9 aa, Homo Sapiens
HSDVGLLEG

SEQ ID NO: 1386879 - protein, 9 aa, Homo Sapiens
GVAAPPLTN

SEQ ID NO: 1386880 - protein, 9 aa, Homo Sapiens
NAMSVLYHI

SEQ ID NO: 1386881 - protein, 9 aa, Homo Sapiens
DYMLSEEII

SEQ ID NO: 1386882 - protein, 9 aa, Homo Sapiens
VLAWWFCRF

SEQ ID NO: 1386883 - protein, 9 aa, Homo Sapiens
EIHDLVKNV

SEQ ID NO: 1386884 - protein, 9 aa, Homo Sapiens
VKAFVTLAS

SEQ ID NO: 1386885 - protein, 9 aa, Homo Sapiens
LKKGRYLRL

SEQ ID NO: 1386886 - protein, 9 aa, Homo Sapiens
GGRSTGLTG

SEQ ID NO: 1386887 - protein, 9 aa, Homo Sapiens
QSLLSILKL

SEQ ID NO: 1386888 - protein, 9 aa, Homo Sapiens
FKVHFFVLT

SEQ ID NO: 1386889 - protein, 9 aa, Homo Sapiens
EVFTIWLIY

SEQ ID NO: 1386890 - protein, 9 aa, Homo Sapiens
TINPAKCIT

SEQ ID NO: 1386891 - protein, 9 aa, Homo Sapiens
IKREIQNSL

SEQ ID NO: 1386892 - protein, 9 aa, Homo Sapiens
GLCVDMNAT

SEQ ID NO: 1386893 - protein, 9 aa, Homo Sapiens
VQRTACDIT

SEQ ID NO: 1386894 - protein, 9 aa, Homo Sapiens
GRSQDCDQV

SEQ ID NO: 1386895 - protein, 9 aa, Homo Sapiens
RSGSRKCKH

SEQ ID NO: 1386896 - protein, 9 aa, Homo Sapiens
TATRTSPAP

SEQ ID NO: 1386897 - protein, 9 aa, Homo Sapiens
HGRERRGRG

SEQ ID NO: 1386898 - protein, 9 aa, Homo Sapiens
AATSSSGCT

SEQ ID NO: 1386899 - protein, 9 aa, Homo Sapiens
VPQAVDGWV

SEQ ID NO: 1386900 - protein, 9 aa, Homo Sapiens
MRCAIWLAE

SEQ ID NO: 1386901 - protein, 9 aa, Homo Sapiens
LVCGNRRGS

SEQ ID NO: 1386902 - protein, 9 aa, Homo Sapiens
SQREEMVKN

SEQ ID NO: 1386903 - protein, 9 aa, Homo Sapiens
IVCVGGLSV

SEQ ID NO: 1386904 - protein, 9 aa, Homo Sapiens
LHRHRGQHA

SEQ ID NO: 1386905 - protein, 9 aa, Homo Sapiens
RSLPHAPAQ

SEQ ID NO: 1386906 - protein, 9 aa, Homo Sapiens
EQLLEALAV

SEQ ID NO: 1386907 - protein, 9 aa, Homo Sapiens
EPTKLLKNI

SEQ ID NO: 1386908 - protein, 9 aa, Homo Sapiens
SDGEFSPIP

SEQ ID NO: 1386909 - protein, 9 aa, Homo Sapiens
EYSYLDSSA

SEQ ID NO: 1386910 - protein, 9 aa, Homo Sapiens
RNEELNMET

SEQ ID NO: 1386911 - protein, 9 aa, Homo Sapiens
MLLSSLSQN

SEQ ID NO: 1386912 - protein, 9 aa, Homo Sapiens
EEECSPAAP

SEQ ID NO: 1386913 - protein, 9 aa, Homo Sapiens
EVSISENAP

SEQ ID NO: 1386914 - protein, 9 aa, Homo Sapiens
DVEYAKEKL

SEQ ID NO: 1386915 - protein, 9 aa, Homo Sapiens
LVCVTTIAD

SEQ ID NO: 1386916 - protein, 9 aa, Homo Sapiens
YRSSQCSSG

SEQ ID NO: 1386917 - protein, 9 aa, Homo Sapiens
LSVLKHPLL

SEQ ID NO: 1386918 - protein, 9 aa, Homo Sapiens
QSATVQAFL

SEQ ID NO: 1386919 - protein, 9 aa, Homo Sapiens
SCKMTGKII

SEQ ID NO: 1386920 - protein, 9 aa, Homo Sapiens
LKKTYEDPY

SEQ ID NO: 1386921 - protein, 9 aa, Homo Sapiens
HYSQMDQQG

SEQ ID NO: 1386922 - protein, 9 aa, Homo Sapiens
GIPQQCIIL

SEQ ID NO: 1386923 - protein, 9 aa, Homo Sapiens
PGHRHPQTA

SEQ ID NO: 1386924 - protein, 9 aa, Homo Sapiens
NQQFRNCIL

SEQ ID NO: 1386925 - protein, 9 aa, Homo Sapiens
LTFSFSLCN

SEQ ID NO: 1386926 - protein, 9 aa, Homo Sapiens
PLHQGQVLP

SEQ ID NO: 1386927 - protein, 9 aa, Homo Sapiens
IKIYQLQFY

SEQ ID NO: 1386928 - protein, 9 aa, Homo Sapiens
GGGCLPPEP

SEQ ID NO: 1386929 - protein, 9 aa, Homo Sapiens
DRQLLCLIN

SEQ ID NO: 1386930 - protein, 9 aa, Homo Sapiens
AVLDSISHS

SEQ ID NO: 1386931 - protein, 9 aa, Homo Sapiens
ELCQVQSQA

SEQ ID NO: 1386932 - protein, 9 aa, Homo Sapiens
LALPATLLV

SEQ ID NO: 1386933 - protein, 9 aa, Homo Sapiens
TGQTKRTRI

SEQ ID NO: 1386934 - protein, 9 aa, Homo Sapiens
FTMHSDRED

SEQ ID NO: 1386935 - protein, 9 aa, Homo Sapiens
VCTCQVRAT

SEQ ID NO: 1386936 - protein, 9 aa, Homo Sapiens
GGDMSNRHV

SEQ ID NO: 1386937 - protein, 9 aa, Homo Sapiens
AAALCSARA

SEQ ID NO: 1386938 - protein, 9 aa, Homo Sapiens
PAEYRYSMA

SEQ ID NO: 1386939 - protein, 9 aa, Homo Sapiens
PGPLEPWLV

SEQ ID NO: 1386940 - protein, 9 aa, Homo Sapiens
LVMLPSCKM

SEQ ID NO: 1386941 - protein, 9 aa, Homo Sapiens
VTSTWMTCP

SEQ ID NO: 1386942 - protein, 9 aa, Homo Sapiens
VTAFIIPAS

SEQ ID NO: 1386943 - protein, 9 aa, Homo Sapiens
EAVCVAGVH

SEQ ID NO: 1386944 - protein, 9 aa, Homo Sapiens
MEMEEMKRR

SEQ ID NO: 1386945 - protein, 9 aa, Homo Sapiens
VEIHCEEKG

SEQ ID NO: 1386946 - protein, 9 aa, Homo Sapiens
ELCRQWLHP

SEQ ID NO: 1386947 - protein, 9 aa, Homo Sapiens
LGFMSSTSF

SEQ ID NO: 1386948 - protein, 9 aa, Homo Sapiens
ICFHVRFDL

SEQ ID NO: 1386949 - protein, 9 aa, Homo Sapiens
KEHEKDQDK

SEQ ID NO: 1386950 - protein, 9 aa, Homo Sapiens
HSRRRRNQS

SEQ ID NO: 1386951 - protein, 9 aa, Homo Sapiens
LRNRIQRCI

SEQ ID NO: 1386952 - protein, 9 aa, Homo Sapiens
REPFTMHSD

SEQ ID NO: 1386953 - protein, 9 aa, Homo Sapiens
KSCKVRLLG

SEQ ID NO: 1386954 - protein, 9 aa, Homo Sapiens
DVECSRYHL

SEQ ID NO: 1386955 - protein, 9 aa, Homo Sapiens
PLGGGGIGY

SEQ ID NO: 1386956 - protein, 9 aa, Homo Sapiens
CFAPRGLHK

SEQ ID NO: 1386957 - protein, 9 aa, Homo Sapiens
PSSSDSSSN

SEQ ID NO: 1386958 - protein, 9 aa, Homo Sapiens
VKDFNREKM

SEQ ID NO: 1386959 - protein, 9 aa, Homo Sapiens
AEIPTGSEA

SEQ ID NO: 1386960 - protein, 9 aa, Homo Sapiens
LKIRGKLGV

SEQ ID NO: 1386961 - protein, 9 aa, Homo Sapiens
TPVRKHNSN

SEQ ID NO: 1386962 - protein, 9 aa, Homo Sapiens
HAELRAELA

SEQ ID NO: 1386963 - protein, 9 aa, Homo Sapiens
GSRSKTRGK

SEQ ID NO: 1386964 - protein, 9 aa, Homo Sapiens
SPKLFSSTV

SEQ ID NO: 1386965 - protein, 9 aa, Homo Sapiens
AVVQKLRVL

SEQ ID NO: 1386966 - protein, 9 aa, Homo Sapiens
GILYKRGAL

SEQ ID NO: 1386967 - protein, 9 aa, Homo Sapiens
PVPYSANLN

SEQ ID NO: 1386968 - protein, 9 aa, Homo Sapiens
LEYNFFEMT

SEQ ID NO: 1386969 - protein, 9 aa, Homo Sapiens
WMSSGSLGR

SEQ ID NO: 1386970 - protein, 9 aa, Homo Sapiens
LPNMDRETK

SEQ ID NO: 1386971 - protein, 9 aa, Homo Sapiens
PWASSVLQG

SEQ ID NO: 1386972 - protein, 9 aa, Homo Sapiens
LILPGSQQQ

SEQ ID NO: 1386973 - protein, 9 aa, Homo Sapiens
AGYLCCALW

SEQ ID NO: 1386974 - protein, 9 aa, Homo Sapiens
RSDGEFSPI

SEQ ID NO: 1386975 - protein, 9 aa, Homo Sapiens
TDEENRDVN

SEQ ID NO: 1386976 - protein, 9 aa, Homo Sapiens
TFYSGDVIL

SEQ ID NO: 1386977 - protein, 9 aa, Homo Sapiens
CNGKKIGDS

SEQ ID NO: 1386978 - protein, 9 aa, Homo Sapiens
RTAGVNIAV

SEQ ID NO: 1386979 - protein, 9 aa, Homo Sapiens
ERRTMTRPS

SEQ ID NO: 1386980 - protein, 9 aa, Homo Sapiens
HVRFDLLGQ

SEQ ID NO: 1386981 - protein, 9 aa, Homo Sapiens
WINTPEQMV

SEQ ID NO: 1386982 - protein, 9 aa, Homo Sapiens
EAPPPSWTP

SEQ ID NO: 1386983 - protein, 9 aa, Homo Sapiens
WDDDDDEKR

SEQ ID NO: 1386984 - protein, 9 aa, Homo Sapiens
ETPIEWEIR

SEQ ID NO: 1386985 - protein, 9 aa, Homo Sapiens
TASGQGKKK

SEQ ID NO: 1386986 - protein, 9 aa, Homo Sapiens
YISILIAYN

SEQ ID NO: 1386987 - protein, 9 aa, Homo Sapiens
WELVTWEVP

SEQ ID NO: 1386988 - protein, 9 aa, Homo Sapiens
SLYVSPSEE

SEQ ID NO: 1386989 - protein, 9 aa, Homo Sapiens
PIPITVTRM

SEQ ID NO: 1386990 - protein, 9 aa, Homo Sapiens
ASQAISARS

SEQ ID NO: 1386991 - protein, 9 aa, Homo Sapiens
SQDCDQVCD

SEQ ID NO: 1386992 - protein, 9 aa, Homo Sapiens
DRAGRMGGR

SEQ ID NO: 1386993 - protein, 9 aa, Homo Sapiens
LYVSPSEEE

SEQ ID NO: 1386994 - protein, 9 aa, Homo Sapiens
ISDDESFNP

SEQ ID NO: 1386995 - protein, 9 aa, Homo Sapiens
EGVQTPVLF

SEQ ID NO: 1386996 - protein, 9 aa, Homo Sapiens
YLSPQRSSQ

SEQ ID NO: 1386997 - protein, 9 aa, Homo Sapiens
READLVIFH

SEQ ID NO: 1386998 - protein, 9 aa, Homo Sapiens
REHRIGIPE

SEQ ID NO: 1386999 - protein, 9 aa, Homo Sapiens
RNQSQNQRG

SEQ ID NO: 1387000 - protein, 9 aa, Homo Sapiens
LYSLPRAFK

SEQ ID NO: 1387001 - protein, 9 aa, Homo Sapiens
FILSCVATG

SEQ ID NO: 1387002 - protein, 9 aa, Homo Sapiens
EDHSRLQKV

SEQ ID NO: 1387003 - protein, 9 aa, Homo Sapiens
QVVGAQRCP

SEQ ID NO: 1387004 - protein, 9 aa, Homo Sapiens
ELRIKRKKK

SEQ ID NO: 1387005 - protein, 9 aa, Homo Sapiens
TEKCVLETE

SEQ ID NO: 1387006 - protein, 9 aa, Homo Sapiens
LLDYTKKPL

SEQ ID NO: 1387007 - protein, 9 aa, Homo Sapiens
LIAGSSLCS

SEQ ID NO: 1387008 - protein, 9 aa, Homo Sapiens
LVILSPKSQ

SEQ ID NO: 1387009 - protein, 9 aa, Homo Sapiens
GDTIECLKR

SEQ ID NO: 1387010 - protein, 9 aa, Homo Sapiens
LGIPKPLGP

SEQ ID NO: 1387011 - protein, 9 aa, Homo Sapiens
RKAITDHVS

SEQ ID NO: 1387012 - protein, 9 aa, Homo Sapiens
PTTHRDMLL

SEQ ID NO: 1387013 - protein, 9 aa, Homo Sapiens
RAPINSAQH

SEQ ID NO: 1387014 - protein, 9 aa, Homo Sapiens
HKINDPWKN

SEQ ID NO: 1387015 - protein, 9 aa, Homo Sapiens
RHGRFRRDH

SEQ ID NO: 1387016 - protein, 9 aa, Homo Sapiens
REKPQEVCV

SEQ ID NO: 1387017 - protein, 9 aa, Homo Sapiens
AGSLAAMQP

SEQ ID NO: 1387018 - protein, 9 aa, Homo Sapiens
DLSSTLERL

SEQ ID NO: 1387019 - protein, 9 aa, Homo Sapiens
REEECSPAA

SEQ ID NO: 1387020 - protein, 9 aa, Homo Sapiens
KHKIAKFEE

SEQ ID NO: 1387021 - protein, 9 aa, Homo Sapiens
GFGEVCTCQ

SEQ ID NO: 1387022 - protein, 9 aa, Homo Sapiens
KNECTGKHP

SEQ ID NO: 1387023 - protein, 9 aa, Homo Sapiens
STRNNLGFT

SEQ ID NO: 1387024 - protein, 9 aa, Homo Sapiens
SDDEIPRKG

SEQ ID NO: 1387025 - protein, 9 aa, Homo Sapiens
FLMKRFLTL

SEQ ID NO: 1387026 - protein, 9 aa, Homo Sapiens
HCSTSFLWA

SEQ ID NO: 1387027 - protein, 9 aa, Homo Sapiens
PRNLPGIAH

SEQ ID NO: 1387028 - protein, 9 aa, Homo Sapiens
YSQMDQQGQ

SEQ ID NO: 1387029 - protein, 9 aa, Homo Sapiens
MDSIKPDLI

SEQ ID NO: 1387030 - protein, 9 aa, Homo Sapiens
MYNSTQGML

SEQ ID NO: 1387031 - protein, 9 aa, Homo Sapiens
KAGTNKPPG

SEQ ID NO: 1387032 - protein, 9 aa, Homo Sapiens
SPLTCRCTT

SEQ ID NO: 1387033 - protein, 9 aa, Homo Sapiens
GDAHVLPQA

SEQ ID NO: 1387034 - protein, 9 aa, Homo Sapiens
PHGAYCVQR

SEQ ID NO: 1387035 - protein, 9 aa, Homo Sapiens
VLDEEVGAA

SEQ ID NO: 1387036 - protein, 9 aa, Homo Sapiens
NMGGNRSIC

SEQ ID NO: 1387037 - protein, 9 aa, Homo Sapiens
FFSQSLICF

SEQ ID NO: 1387038 - protein, 9 aa, Homo Sapiens
VMCWRPPSP

SEQ ID NO: 1387039 - protein, 9 aa, Homo Sapiens
WLILKGLEE

SEQ ID NO: 1387040 - protein, 9 aa, Homo Sapiens
RCIADSQLA

SEQ ID NO: 1387041 - protein, 9 aa, Homo Sapiens
AAGSQDVGI

SEQ ID NO: 1387042 - protein, 9 aa, Homo Sapiens
SVRITIHWT

SEQ ID NO: 1387043 - protein, 9 aa, Homo Sapiens
HGPLGDRCA

SEQ ID NO: 1387044 - protein, 9 aa, Homo Sapiens
AAMWPGTDI

SEQ ID NO: 1387045 - protein, 9 aa, Homo Sapiens
TTLSWTLWL

SEQ ID NO: 1387046 - protein, 9 aa, Homo Sapiens
RSGRALPLQ

SEQ ID NO: 1387047 - protein, 9 aa, Homo Sapiens
ADEYLNKVI

SEQ ID NO: 1387048 - protein, 9 aa, Homo Sapiens
VDGTFILSC

SEQ ID NO: 1387049 - protein, 9 aa, Homo Sapiens
GKCFKKRPQ

SEQ ID NO: 1387050 - protein, 9 aa, Homo Sapiens
VLMRVLDAN

SEQ ID NO: 1387051 - protein, 9 aa, Homo Sapiens
FSPRVTRIL

SEQ ID NO: 1387052 - protein, 9 aa, Homo Sapiens
TAAVGKARR

SEQ ID NO: 1387053 - protein, 9 aa, Homo Sapiens
VEDPESKQT

SEQ ID NO: 1387054 - protein, 9 aa, Homo Sapiens
LVTWEVPFA

SEQ ID NO: 1387055 - protein, 9 aa, Homo Sapiens
PELVDTHIH

SEQ ID NO: 1387056 - protein, 9 aa, Homo Sapiens
DNKSKICSE

SEQ ID NO: 1387057 - protein, 9 aa, Homo Sapiens
RSRSGSRKC

SEQ ID NO: 1387058 - protein, 9 aa, Homo Sapiens
IISTQVSPT

SEQ ID NO: 1387059 - protein, 9 aa, Homo Sapiens
SNCDEIHDL

SEQ ID NO: 1387060 - protein, 9 aa, Homo Sapiens
KWELELKHW

SEQ ID NO: 1387061 - protein, 9 aa, Homo Sapiens
EWPAVPSSC

SEQ ID NO: 1387062 - protein, 9 aa, Homo Sapiens
YALNCGEGT

SEQ ID NO: 1387063 - protein, 9 aa, Homo Sapiens
VIFHFPLYW

SEQ ID NO: 1387064 - protein, 9 aa, Homo Sapiens
QQQQQQSQQ

SEQ ID NO: 1387065 - protein, 9 aa, Homo Sapiens
WAPQTAVLR

SEQ ID NO: 1387066 - protein, 9 aa, Homo Sapiens
DKSQLDAAN

SEQ ID NO: 1387067 - protein, 9 aa, Homo Sapiens
SRGKAPQRE

SEQ ID NO: 1387068 - protein, 9 aa, Homo Sapiens
TLSWTLWLF

SEQ ID NO: 1387069 - protein, 9 aa, Homo Sapiens
LTTSEEAQK

SEQ ID NO: 1387070 - protein, 9 aa, Homo Sapiens
TILILKFLC

SEQ ID NO: 1387071 - protein, 9 aa, Homo Sapiens
GTWDQDGKG

SEQ ID NO: 1387072 - protein, 9 aa, Homo Sapiens
SPPLDSTKS

SEQ ID NO: 1387073 - protein, 9 aa, Homo Sapiens
HSQVIETTN

SEQ ID NO: 1387074 - protein, 9 aa, Homo Sapiens
EHRDNLVVV

SEQ ID NO: 1387075 - protein, 9 aa, Homo Sapiens
ERRQELPGK

SEQ ID NO: 1387076 - protein, 9 aa, Homo Sapiens
GSKRSSRSN

SEQ ID NO: 1387077 - protein, 9 aa, Homo Sapiens
RDWHSQRSP

SEQ ID NO: 1387078 - protein, 9 aa, Homo Sapiens
GCLPPEPGD

SEQ ID NO: 1387079 - protein, 9 aa, Homo Sapiens
CCRPRTRTC

SEQ ID NO: 1387080 - protein, 9 aa, Homo Sapiens
APVTSTWMT

SEQ ID NO: 1387081 - protein, 9 aa, Homo Sapiens
GTNKPPGAG

SEQ ID NO: 1387082 - protein, 9 aa, Homo Sapiens
DEEVGAAGQ

SEQ ID NO: 1387083 - protein, 9 aa, Homo Sapiens
SGSRIPSAP

SEQ ID NO: 1387084 - protein, 9 aa, Homo Sapiens
CAKITSVVL

SEQ ID NO: 1387085 - protein, 9 aa, Homo Sapiens
RWDTIIFSC

SEQ ID NO: 1387086 - protein, 9 aa, Homo Sapiens
GSLHKTRPL

SEQ ID NO: 1387087 - protein, 9 aa, Homo Sapiens
GPPGPNEAP

SEQ ID NO: 1387088 - protein, 9 aa, Homo Sapiens
GGDLAATVQ

SEQ ID NO: 1387089 - protein, 9 aa, Homo Sapiens
CSHKVLAWW

SEQ ID NO: 1387090 - protein, 9 aa, Homo Sapiens
PEQFPFTSP

SEQ ID NO: 1387091 - protein, 9 aa, Homo Sapiens
SGHVRVHPD

SEQ ID NO: 1387092 - protein, 9 aa, Homo Sapiens
PDKEVRQAV

SEQ ID NO: 1387093 - protein, 9 aa, Homo Sapiens
SLSRSLQNL

SEQ ID NO: 1387094 - protein, 9 aa, Homo Sapiens
EWRLGFLEP

SEQ ID NO: 1387095 - protein, 9 aa, Homo Sapiens
GRSHVQVGG

SEQ ID NO: 1387096 - protein, 9 aa, Homo Sapiens
PVRSINHAN

SEQ ID NO: 1387097 - protein, 9 aa, Homo Sapiens
QPPPQAPSQ

SEQ ID NO: 1387098 - protein, 9 aa, Homo Sapiens
QSLICFHVR

SEQ ID NO: 1387099 - protein, 9 aa, Homo Sapiens
ECWTGHTSD

SEQ ID NO: 1387100 - protein, 9 aa, Homo Sapiens
KGMNSHVPD

SEQ ID NO: 1387101 - protein, 9 aa, Homo Sapiens
VMIQTFPLH

SEQ ID NO: 1387102 - protein, 9 aa, Homo Sapiens
SISVVGMSP

SEQ ID NO: 1387103 - protein, 9 aa, Homo Sapiens
VWPERGLPP

SEQ ID NO: 1387104 - protein, 9 aa, Homo Sapiens
QCSSGSCPS

SEQ ID NO: 1387105 - protein, 9 aa, Homo Sapiens
DECWTGHTS

SEQ ID NO: 1387106 - protein, 9 aa, Homo Sapiens
LQEAERYKS

SEQ ID NO: 1387107 - protein, 9 aa, Homo Sapiens
FSTLTTHKN

SEQ ID NO: 1387108 - protein, 9 aa, Homo Sapiens
PVTAFIIPA

SEQ ID NO: 1387109 - protein, 9 aa, Homo Sapiens
LARLLAGSV

SEQ ID NO: 1387110 - protein, 9 aa, Homo Sapiens
KPIISETPL

SEQ ID NO: 1387111 - protein, 9 aa, Homo Sapiens
REALEKLHS

SEQ ID NO: 1387112 - protein, 9 aa, Homo Sapiens
GVPTQLVLS

SEQ ID NO: 1387113 - protein, 9 aa, Homo Sapiens
PPSRGPPGP

SEQ ID NO: 1387114 - protein, 9 aa, Homo Sapiens
IGSLDGGAN

SEQ ID NO: 1387115 - protein, 9 aa, Homo Sapiens
QEQGKHKIA

SEQ ID NO: 1387116 - protein, 9 aa, Homo Sapiens
KEHLMLEEL

SEQ ID NO: 1387117 - protein, 9 aa, Homo Sapiens
GSEEEGKRK

SEQ ID NO: 1387118 - protein, 9 aa, Homo Sapiens
QDGARCPSC

SEQ ID NO: 1387119 - protein, 9 aa, Homo Sapiens
WPRFWACGR

SEQ ID NO: 1387120 - protein, 9 aa, Homo Sapiens
EMTIKFAPA

SEQ ID NO: 1387121 - protein, 9 aa, Homo Sapiens
HSRLQKVPK

SEQ ID NO: 1387122 - protein, 9 aa, Homo Sapiens
LRQSNQSLL

SEQ ID NO: 1387123 - protein, 9 aa, Homo Sapiens
PWTRCLRMR

SEQ ID NO: 1387124 - protein, 9 aa, Homo Sapiens
LSWRRWGTL

SEQ ID NO: 1387125 - protein, 9 aa, Homo Sapiens
ECKDRGKAF

SEQ ID NO: 1387126 - protein, 9 aa, Homo Sapiens
DFHLQNSTL

SEQ ID NO: 1387127 - protein, 9 aa, Homo Sapiens
TSLGWCLTG

SEQ ID NO: 1387128 - protein, 9 aa, Homo Sapiens
AVSNNIVVH

SEQ ID NO: 1387129 - protein, 9 aa, Homo Sapiens
VKVTATGQT

SEQ ID NO: 1387130 - protein, 9 aa, Homo Sapiens
SNMDGWLRN

SEQ ID NO: 1387131 - protein, 9 aa, Homo Sapiens
RPGGEDQRL

SEQ ID NO: 1387132 - protein, 9 aa, Homo Sapiens
YNFFEMTIK

SEQ ID NO: 1387133 - protein, 9 aa, Homo Sapiens
REKIINPTI

SEQ ID NO: 1387134 - protein, 9 aa, Homo Sapiens
GWGVGGVEA

SEQ ID NO: 1387135 - protein, 9 aa, Homo Sapiens
GEMRGVFLF

SEQ ID NO: 1387136 - protein, 9 aa, Homo Sapiens
VTLAVNMVG

SEQ ID NO: 1387137 - protein, 9 aa, Homo Sapiens
HKIAKFEEK

SEQ ID NO: 1387138 - protein, 9 aa, Homo Sapiens
QNELKKTYE

SEQ ID NO: 1387139 - protein, 9 aa, Homo Sapiens
IFAIGPVGN

SEQ ID NO: 1387140 - protein, 9 aa, Homo Sapiens
NCVQGVAAP

SEQ ID NO: 1387141 - protein, 9 aa, Homo Sapiens
EEWYNDSVE

SEQ ID NO: 1387142 - protein, 9 aa, Homo Sapiens
SARVSDLHP

SEQ ID NO: 1387143 - protein, 9 aa, Homo Sapiens
TQKHWASCS

SEQ ID NO: 1387144 - protein, 9 aa, Homo Sapiens
RKCKHRKRS

SEQ ID NO: 1387145 - protein, 9 aa, Homo Sapiens
SETSLPLDM

SEQ ID NO: 1387146 - protein, 9 aa, Homo Sapiens
KFAPFFVPM

SEQ ID NO: 1387147 - protein, 9 aa, Homo Sapiens
GPCILYCAP

SEQ ID NO: 1387148 - protein, 9 aa, Homo Sapiens
TSPTIPIND

SEQ ID NO: 1387149 - protein, 9 aa, Homo Sapiens
AGQKYHSVC

SEQ ID NO: 1387150 - protein, 9 aa, Homo Sapiens
MLPSCKMTG

SEQ ID NO: 1387151 - protein, 9 aa, Homo Sapiens
WLCHLVPGD

SEQ ID NO: 1387152 - protein, 9 aa, Homo Sapiens
TLAGPPRRV

SEQ ID NO: 1387153 - protein, 9 aa, Homo Sapiens
FDINSHTGR

SEQ ID NO: 1387154 - protein, 9 aa, Homo Sapiens
PGPSEGVIA

SEQ ID NO: 1387155 - protein, 9 aa, Homo Sapiens
ETQDVQMKG

SEQ ID NO: 1387156 - protein, 9 aa, Homo Sapiens
HVDATGQQD

SEQ ID NO: 1387157 - protein, 9 aa, Homo Sapiens
TVSQARLSA

SEQ ID NO: 1387158 - protein, 9 aa, Homo Sapiens
SHLNLDDRH

SEQ ID NO: 1387159 - protein, 9 aa, Homo Sapiens
HRDMLLSPT

SEQ ID NO: 1387160 - protein, 9 aa, Homo Sapiens
CLTTTQSKV

SEQ ID NO: 1387161 - protein, 9 aa, Homo Sapiens
LVVEIVLVD

SEQ ID NO: 1387162 - protein, 9 aa, Homo Sapiens
GHSLETGAP

SEQ ID NO: 1387163 - protein, 9 aa, Homo Sapiens
TIPNINFQC

SEQ ID NO: 1387164 - protein, 9 aa, Homo Sapiens
PIDDGWMYD

SEQ ID NO: 1387165 - protein, 9 aa, Homo Sapiens
GEFSPIPIT

SEQ ID NO: 1387166 - protein, 9 aa, Homo Sapiens
VNCVQGVAA

SEQ ID NO: 1387167 - protein, 9 aa, Homo Sapiens
DGCHRLPQD

SEQ ID NO: 1387168 - protein, 9 aa, Homo Sapiens
LVASSQNWG

SEQ ID NO: 1387169 - protein, 9 aa, Homo Sapiens
IWVGAQEAL

SEQ ID NO: 1387170 - protein, 9 aa, Homo Sapiens
FHEMVTFKD

SEQ ID NO: 1387171 - protein, 9 aa, Homo Sapiens
ILNRLDIEV

SEQ ID NO: 1387172 - protein, 9 aa, Homo Sapiens
VRDLTYSVK

SEQ ID NO: 1387173 - protein, 9 aa, Homo Sapiens
VRCIPNTFK

SEQ ID NO: 1387174 - protein, 9 aa, Homo Sapiens
CIVCVGGLS

SEQ ID NO: 1387175 - protein, 9 aa, Homo Sapiens
RWGTLGLVA

SEQ ID NO: 1387176 - protein, 9 aa, Homo Sapiens
LMKRFLTLA

SEQ ID NO: 1387177 - protein, 9 aa, Homo Sapiens
HVMKLRRAA

SEQ ID NO: 1387178 - protein, 9 aa, Homo Sapiens
VERIGLATA

SEQ ID NO: 1387179 - protein, 9 aa, Homo Sapiens
QSVLDMLHH

SEQ ID NO: 1387180 - protein, 9 aa, Homo Sapiens
TATGQTKRT

SEQ ID NO: 1387181 - protein, 9 aa, Homo Sapiens
GPGPLEPWL

SEQ ID NO: 1387182 - protein, 9 aa, Homo Sapiens
LHSEMEEEK

SEQ ID NO: 1387183 - protein, 9 aa, Homo Sapiens
SLRPEVGGP

SEQ ID NO: 1387184 - protein, 9 aa, Homo Sapiens
SIKPIISET

SEQ ID NO: 1387185 - protein, 9 aa, Homo Sapiens
PGSGMEMEE

SEQ ID NO: 1387186 - protein, 9 aa, Homo Sapiens
PSLRAARAH

SEQ ID NO: 1387187 - protein, 9 aa, Homo Sapiens
KKPLHQAIL

SEQ ID NO: 1387188 - protein, 9 aa, Homo Sapiens
GTFGGNITQ

SEQ ID NO: 1387189 - protein, 9 aa, Homo Sapiens
WTCGLGSSC

SEQ ID NO: 1387190 - protein, 9 aa, Homo Sapiens
AENTVDTAT

SEQ ID NO: 1387191 - protein, 9 aa, Homo Sapiens
KIILVFTFA

SEQ ID NO: 1387192 - protein, 9 aa, Homo Sapiens
GPAAWKKRF

SEQ ID NO: 1387193 - protein, 9 aa, Homo Sapiens
AAYSDLFCS

SEQ ID NO: 1387194 - protein, 9 aa, Homo Sapiens
TLQLVVLDV

SEQ ID NO: 1387195 - protein, 9 aa, Homo Sapiens
STQVEQLLY

SEQ ID NO: 1387196 - protein, 9 aa, Homo Sapiens
LSFLQCLTE

SEQ ID NO: 1387197 - protein, 9 aa, Homo Sapiens
NRSLILKRK

SEQ ID NO: 1387198 - protein, 9 aa, Homo Sapiens
IGSEDGEPL

SEQ ID NO: 1387199 - protein, 9 aa, Homo Sapiens
WKKRFAACW

SEQ ID NO: 1387200 - protein, 9 aa, Homo Sapiens
NRKEDMEIM

SEQ ID NO: 1387201 - protein, 9 aa, Homo Sapiens
YDTVQRTGR

SEQ ID NO: 1387202 - protein, 9 aa, Homo Sapiens
SSCRRDDSS

SEQ ID NO: 1387203 - protein, 9 aa, Homo Sapiens
GEEGGCASG

SEQ ID NO: 1387204 - protein, 9 aa, Homo Sapiens
TAAKRKWKL

SEQ ID NO: 1387205 - protein, 9 aa, Homo Sapiens
AAGAQPASS

SEQ ID NO: 1387206 - protein, 9 aa, Homo Sapiens
TLVLDVSSI

SEQ ID NO: 1387207 - protein, 9 aa, Homo Sapiens
NHCQMSGTS

SEQ ID NO: 1387208 - protein, 9 aa, Homo Sapiens
WRAGFQWGE

SEQ ID NO: 1387209 - protein, 9 aa, Homo Sapiens
HVHIRVLGA

SEQ ID NO: 1387210 - protein, 9 aa, Homo Sapiens
SEGLFQHLA

SEQ ID NO: 1387211 - protein, 9 aa, Homo Sapiens
IFITTIFMA

SEQ ID NO: 1387212 - protein, 9 aa, Homo Sapiens
AKITSVVLV

SEQ ID NO: 1387213 - protein, 9 aa, Homo Sapiens
FLQCLTEYM

SEQ ID NO: 1387214 - protein, 9 aa, Homo Sapiens
DEQVAMRCA

SEQ ID NO: 1387215 - protein, 9 aa, Homo Sapiens
GHRHPQTAM

SEQ ID NO: 1387216 - protein, 9 aa, Homo Sapiens
WEQLLEALA

SEQ ID NO: 1387217 - protein, 9 aa, Homo Sapiens
SVTLAVNMV

SEQ ID NO: 1387218 - protein, 9 aa, Homo Sapiens
KKVYVTSQQ

SEQ ID NO: 1387219 - protein, 9 aa, Homo Sapiens
VLPGLDVVA

SEQ ID NO: 1387220 - protein, 9 aa, Homo Sapiens
KSRGPAAWK

SEQ ID NO: 1387221 - protein, 9 aa, Homo Sapiens
APRRCQRKA

SEQ ID NO: 1387222 - protein, 9 aa, Homo Sapiens
VPACSHKVL

SEQ ID NO: 1387223 - protein, 9 aa, Homo Sapiens
VSGIDLTKK

SEQ ID NO: 1387224 - protein, 9 aa, Homo Sapiens
RPRTRTCPS

SEQ ID NO: 1387225 - protein, 9 aa, Homo Sapiens
WLHPEVRSK

SEQ ID NO: 1387226 - protein, 9 aa, Homo Sapiens
VIRCCQQKE

SEQ ID NO: 1387227 - protein, 9 aa, Homo Sapiens
PWNRGSCSS

SEQ ID NO: 1387228 - protein, 9 aa, Homo Sapiens
VTLGDEVFD

SEQ ID NO: 1387229 - protein, 9 aa, Homo Sapiens
FPLHQGQVL

SEQ ID NO: 1387230 - protein, 9 aa, Homo Sapiens
PDCTPMYTD

SEQ ID NO: 1387231 - protein, 9 aa, Homo Sapiens
DGATWTDIF

SEQ ID NO: 1387232 - protein, 9 aa, Homo Sapiens
RSLSTSTEE

SEQ ID NO: 1387233 - protein, 9 aa, Homo Sapiens
YFHIYTDKL

SEQ ID NO: 1387234 - protein, 9 aa, Homo Sapiens
QLFKELGKG

SEQ ID NO: 1387235 - protein, 9 aa, Homo Sapiens
PPTLGCSMQ

SEQ ID NO: 1387236 - protein, 9 aa, Homo Sapiens
IGVAIQEEL

SEQ ID NO: 1387237 - protein, 9 aa, Homo Sapiens
PTLPFEVVL

SEQ ID NO: 1387238 - protein, 9 aa, Homo Sapiens
VHIFKYPSI

SEQ ID NO: 1387239 - protein, 9 aa, Homo Sapiens
PCPAPAPTS

SEQ ID NO: 1387240 - protein, 9 aa, Homo Sapiens
HYLSAQRES

SEQ ID NO: 1387241 - protein, 9 aa, Homo Sapiens
GCSPSMSTA

SEQ ID NO: 1387242 - protein, 9 aa, Homo Sapiens
LDVVAQMDE

SEQ ID NO: 1387243 - protein, 9 aa, Homo Sapiens
LCHLVPGDL

SEQ ID NO: 1387244 - protein, 9 aa, Homo Sapiens
DAVVASSSG

SEQ ID NO: 1387245 - protein, 9 aa, Homo Sapiens
VTPWTLLIL

SEQ ID NO: 1387246 - protein, 9 aa, Homo Sapiens
ERQTEKCVL

SEQ ID NO: 1387247 - protein, 9 aa, Homo Sapiens
VGQISTLVL

SEQ ID NO: 1387248 - protein, 9 aa, Homo Sapiens
QTRKTCIRR

SEQ ID NO: 1387249 - protein, 9 aa, Homo Sapiens
FGQMELPAC

SEQ ID NO: 1387250 - protein, 9 aa, Homo Sapiens
WVSFSLCGV

SEQ ID NO: 1387251 - protein, 9 aa, Homo Sapiens
EWLQAIKMG

SEQ ID NO: 1387252 - protein, 9 aa, Homo Sapiens
QGQACQDQW

SEQ ID NO: 1387253 - protein, 9 aa, Homo Sapiens
VAKDGRLAG

SEQ ID NO: 1387254 - protein, 9 aa, Homo Sapiens
PSAPAAAPP

SEQ ID NO: 1387255 - protein, 9 aa, Homo Sapiens
FEVFTIWLI

SEQ ID NO: 1387256 - protein, 9 aa, Homo Sapiens
YVAAFFTFS

SEQ ID NO: 1387257 - protein, 9 aa, Homo Sapiens
DKARRVIVE

SEQ ID NO: 1387258 - protein, 9 aa, Homo Sapiens
GNPYWMALR

SEQ ID NO: 1387259 - protein, 9 aa, Homo Sapiens
VPTPVRKHN

SEQ ID NO: 1387260 - protein, 9 aa, Homo Sapiens
SALLGKKMT

SEQ ID NO: 1387261 - protein, 9 aa, Homo Sapiens
IPKPLGPKS

SEQ ID NO: 1387262 - protein, 9 aa, Homo Sapiens
MTLLFEVFT

SEQ ID NO: 1387263 - protein, 9 aa, Homo Sapiens
LHELVLTFN

SEQ ID NO: 1387264 - protein, 9 aa, Homo Sapiens
STPPCWWTM

SEQ ID NO: 1387265 - protein, 9 aa, Homo Sapiens
WPHGAYCVQ

SEQ ID NO: 1387266 - protein, 9 aa, Homo Sapiens
RRYRSCALS

SEQ ID NO: 1387267 - protein, 9 aa, Homo Sapiens
GGADGSITR

SEQ ID NO: 1387268 - protein, 9 aa, Homo Sapiens
PTPSSPAAA

SEQ ID NO: 1387269 - protein, 9 aa, Homo Sapiens
SVAGSLAAM

SEQ ID NO: 1387270 - protein, 9 aa, Homo Sapiens
HRGLSSPRL

SEQ ID NO: 1387271 - protein, 9 aa, Homo Sapiens
MIKMLVNGK

SEQ ID NO: 1387272 - protein, 9 aa, Homo Sapiens
NWSLFTGLR

SEQ ID NO: 1387273 - protein, 9 aa, Homo Sapiens
YCLHPDVAH

SEQ ID NO: 1387274 - protein, 9 aa, Homo Sapiens
SCWSASSPS

SEQ ID NO: 1387275 - protein, 9 aa, Homo Sapiens
FFVLVNLEV

SEQ ID NO: 1387276 - protein, 9 aa, Homo Sapiens
TVPTPVRKH

SEQ ID NO: 1387277 - protein, 9 aa, Homo Sapiens
KEMKYEHQK

SEQ ID NO: 1387278 - protein, 9 aa, Homo Sapiens
GQASLIDGV

SEQ ID NO: 1387279 - protein, 9 aa, Homo Sapiens
LWGGPCGFP

SEQ ID NO: 1387280 - protein, 9 aa, Homo Sapiens
YPFHVLALE

SEQ ID NO: 1387281 - protein, 9 aa, Homo Sapiens
WRPALGGVF

SEQ ID NO: 1387282 - protein, 9 aa, Homo Sapiens
RNPTLFPRP

SEQ ID NO: 1387283 - protein, 9 aa, Homo Sapiens
HITSLAGQA

SEQ ID NO: 1387284 - protein, 9 aa, Homo Sapiens
CIKWLRKCA

SEQ ID NO: 1387285 - protein, 9 aa, Homo Sapiens
QLNTTLPQE

SEQ ID NO: 1387286 - protein, 9 aa, Homo Sapiens
RITTLEKHY

SEQ ID NO: 1387287 - protein, 9 aa, Homo Sapiens
MNAFILLPC

SEQ ID NO: 1387288 - protein, 9 aa, Homo Sapiens
FCATLLAFL

SEQ ID NO: 1387289 - protein, 9 aa, Homo Sapiens
PREHRIGIP

SEQ ID NO: 1387290 - protein, 9 aa, Homo Sapiens
TQVSPTRNF

SEQ ID NO: 1387291 - protein, 9 aa, Homo Sapiens
REKMPLMIF

SEQ ID NO: 1387292 - protein, 9 aa, Homo Sapiens
IPQEAVCVA

SEQ ID NO: 1387293 - protein, 9 aa, Homo Sapiens
RPWSQKTEK

SEQ ID NO: 1387294 - protein, 9 aa, Homo Sapiens
RLGGVLPCT

SEQ ID NO: 1387295 - protein, 9 aa, Homo Sapiens
HGAYCVQRC

SEQ ID NO: 1387296 - protein, 9 aa, Homo Sapiens
DLCKNGQVW

SEQ ID NO: 1387297 - protein, 9 aa, Homo Sapiens
RDCLPTDVE

SEQ ID NO: 1387298 - protein, 9 aa, Homo Sapiens
TTSCMWLWM

SEQ ID NO: 1387299 - protein, 9 aa, Homo Sapiens
LSWTLWLFW

SEQ ID NO: 1387300 - protein, 9 aa, Homo Sapiens
FRDLNYLRV

SEQ ID NO: 1387301 - protein, 9 aa, Homo Sapiens
GTETSSSET

SEQ ID NO: 1387302 - protein, 9 aa, Homo Sapiens
LKHMSHGEE

SEQ ID NO: 1387303 - protein, 9 aa, Homo Sapiens
IPPDVIAKK

SEQ ID NO: 1387304 - protein, 9 aa, Homo Sapiens
GKNFRKEKN

SEQ ID NO: 1387305 - protein, 9 aa, Homo Sapiens
LPPAPAPWL

SEQ ID NO: 1387306 - protein, 9 aa, Homo Sapiens
RCPACCMQK

SEQ ID NO: 1387307 - protein, 9 aa, Homo Sapiens
PPPQAPSQV

SEQ ID NO: 1387308 - protein, 9 aa, Homo Sapiens
GWMPDQLYR

SEQ ID NO: 1387309 - protein, 9 aa, Homo Sapiens
EAWLWYHQV

SEQ ID NO: 1387310 - protein, 9 aa, Homo Sapiens
MKTRTCSWQ

SEQ ID NO: 1387311 - protein, 9 aa, Homo Sapiens
TCFNQTYTI

SEQ ID NO: 1387312 - protein, 9 aa, Homo Sapiens
LNPAAQDGA

SEQ ID NO: 1387313 - protein, 9 aa, Homo Sapiens
RVSNMDGWL

SEQ ID NO: 1387314 - protein, 9 aa, Homo Sapiens
SSQCSSGSC

SEQ ID NO: 1387315 - protein, 9 aa, Homo Sapiens
PRLDHQATY

SEQ ID NO: 1387316 - protein, 9 aa, Homo Sapiens
ILPKSTWDL

SEQ ID NO: 1387317 - protein, 9 aa, Homo Sapiens
WNLSQVGVK

SEQ ID NO: 1387318 - protein, 9 aa, Homo Sapiens
DQRLCHGGL

SEQ ID NO: 1387319 - protein, 9 aa, Homo Sapiens
PECFNETIG

SEQ ID NO: 1387320 - protein, 9 aa, Homo Sapiens
RSQVSGGPP

SEQ ID NO: 1387321 - protein, 9 aa, Homo Sapiens
KHLVDELLM

SEQ ID NO: 1387322 - protein, 9 aa, Homo Sapiens
SLAEEQSEI

SEQ ID NO: 1387323 - protein, 9 aa, Homo Sapiens
RALPRRLGA

SEQ ID NO: 1387324 - protein, 9 aa, Homo Sapiens
FNMNAMSVL

SEQ ID NO: 1387325 - protein, 9 aa, Homo Sapiens
MARDRSVHN

SEQ ID NO: 1387326 - protein, 9 aa, Homo Sapiens
PEAAQLSED

SEQ ID NO: 1387327 - protein, 9 aa, Homo Sapiens
TSLHQATRK

SEQ ID NO: 1387328 - protein, 9 aa, Homo Sapiens
VPGDLPWRG

SEQ ID NO: 1387329 - protein, 9 aa, Homo Sapiens
QLYRPLVLT

SEQ ID NO: 1387330 - protein, 9 aa, Homo Sapiens
SPHTSYREE

SEQ ID NO: 1387331 - protein, 9 aa, Homo Sapiens
HQRTGRQHP

SEQ ID NO: 1387332 - protein, 9 aa, Homo Sapiens
LWDLLRFLL

SEQ ID NO: 1387333 - protein, 9 aa, Homo Sapiens
LKHKLNSMP

SEQ ID NO: 1387334 - protein, 9 aa, Homo Sapiens
REEERCKKR

SEQ ID NO: 1387335 - protein, 9 aa, Homo Sapiens
VLPKKICVR

SEQ ID NO: 1387336 - protein, 9 aa, Homo Sapiens
PKETPIEWE

SEQ ID NO: 1387337 - protein, 9 aa, Homo Sapiens
RDLFLRISR

SEQ ID NO: 1387338 - protein, 9 aa, Homo Sapiens
KMVEKAKTW

SEQ ID NO: 1387339 - protein, 9 aa, Homo Sapiens
MNAMSVLYH

SEQ ID NO: 1387340 - protein, 9 aa, Homo Sapiens
RSPTRCCRP

SEQ ID NO: 1387341 - protein, 9 aa, Homo Sapiens
ITEDVRVQE

SEQ ID NO: 1387342 - protein, 9 aa, Homo Sapiens
IYQLQFYLQ

SEQ ID NO: 1387343 - protein, 9 aa, Homo Sapiens
PPTHARTTA

SEQ ID NO: 1387344 - protein, 9 aa, Homo Sapiens
LLGKCFKKR

SEQ ID NO: 1387345 - protein, 9 aa, Homo Sapiens
TDSGNVQKA

SEQ ID NO: 1387346 - protein, 9 aa, Homo Sapiens
VRHVLSCMG

SEQ ID NO: 1387347 - protein, 9 aa, Homo Sapiens
DLVLNVEMV

SEQ ID NO: 1387348 - protein, 9 aa, Homo Sapiens
YPLGIVQHY

SEQ ID NO: 1387349 - protein, 9 aa, Homo Sapiens
NRTPTLREK

SEQ ID NO: 1387350 - protein, 9 aa, Homo Sapiens
LIFRDWHSQ

SEQ ID NO: 1387351 - protein, 9 aa, Homo Sapiens
TPTTSSLVA

SEQ ID NO: 1387352 - protein, 9 aa, Homo Sapiens
CSPAAPPPL

SEQ ID NO: 1387353 - protein, 9 aa, Homo Sapiens
PRAQCVVLE

SEQ ID NO: 1387354 - protein, 9 aa, Homo Sapiens
LRPWWMPSL

SEQ ID NO: 1387355 - protein, 9 aa, Homo Sapiens
PGFTKHLFR

SEQ ID NO: 1387356 - protein, 9 aa, Homo Sapiens
DIKPANMFI

SEQ ID NO: 1387357 - protein, 9 aa, Homo Sapiens
HDLVKNVLK

SEQ ID NO: 1387358 - protein, 9 aa, Homo Sapiens
PAPTCVSST

SEQ ID NO: 1387359 - protein, 9 aa, Homo Sapiens
ILIFRDWHS

SEQ ID NO: 1387360 - protein, 9 aa, Homo Sapiens
TDVGIVLKV

SEQ ID NO: 1387361 - protein, 9 aa, Homo Sapiens
HHRARFLHE

SEQ ID NO: 1387362 - protein, 9 aa, Homo Sapiens
LVATVLMII

SEQ ID NO: 1387363 - protein, 9 aa, Homo Sapiens
MAMCFIKNQ

SEQ ID NO: 1387364 - protein, 9 aa, Homo Sapiens
AAALQSGRP

SEQ ID NO: 1387365 - protein, 9 aa, Homo Sapiens
DINAVCADP

SEQ ID NO: 1387366 - protein, 9 aa, Homo Sapiens
LFRHLLGDA

SEQ ID NO: 1387367 - protein, 9 aa, Homo Sapiens
RMQRFTSPK

SEQ ID NO: 1387368 - protein, 9 aa, Homo Sapiens
SNIESTSMS

SEQ ID NO: 1387369 - protein, 9 aa, Homo Sapiens
SHPRLDHQA

SEQ ID NO: 1387370 - protein, 9 aa, Homo Sapiens
DTIIFSCFV

SEQ ID NO: 1387371 - protein, 9 aa, Homo Sapiens
PEENDTTLQ

SEQ ID NO: 1387372 - protein, 9 aa, Homo Sapiens
SHSDVGLLE

SEQ ID NO: 1387373 - protein, 9 aa, Homo Sapiens
SWRRAPAVL

SEQ ID NO: 1387374 - protein, 9 aa, Homo Sapiens
TLLVTAKKP

SEQ ID NO: 1387375 - protein, 9 aa, Homo Sapiens
TSSFEQHQE

SEQ ID NO: 1387376 - protein, 9 aa, Homo Sapiens
TKPTDTFLQ

SEQ ID NO: 1387377 - protein, 9 aa, Homo Sapiens
ETPAEYRYS

SEQ ID NO: 1387378 - protein, 9 aa, Homo Sapiens
HWCPGLKIL

SEQ ID NO: 1387379 - protein, 9 aa, Homo Sapiens
TCPSPPWSP

SEQ ID NO: 1387380 - protein, 9 aa, Homo Sapiens
EHQHSLKKS

SEQ ID NO: 1387381 - protein, 9 aa, Homo Sapiens
KTSFIIRSL

SEQ ID NO: 1387382 - protein, 9 aa, Homo Sapiens
VKDVVCKVH

SEQ ID NO: 1387383 - protein, 9 aa, Homo Sapiens
FHLWTRQRI

SEQ ID NO: 1387384 - protein, 9 aa, Homo Sapiens
TPSRWAPRS

SEQ ID NO: 1387385 - protein, 9 aa, Homo Sapiens
HSEVMLDDE

SEQ ID NO: 1387386 - protein, 9 aa, Homo Sapiens
TSHMNSVKD

SEQ ID NO: 1387387 - protein, 9 aa, Homo Sapiens
RCTTPPASP

SEQ ID NO: 1387388 - protein, 9 aa, Homo Sapiens
ASHSDVGLL

SEQ ID NO: 1387389 - protein, 9 aa, Homo Sapiens
NRSFEGILY

SEQ ID NO: 1387390 - protein, 9 aa, Homo Sapiens
NDGVFQRLW

SEQ ID NO: 1387391 - protein, 9 aa, Homo Sapiens
ILILKFLCL

SEQ ID NO: 1387392 - protein, 9 aa, Homo Sapiens
EEEEDDEEA

SEQ ID NO: 1387393 - protein, 9 aa, Homo Sapiens
CSSLKNHKG

SEQ ID NO: 1387394 - protein, 9 aa, Homo Sapiens
GLQGPPGAA

SEQ ID NO: 1387395 - protein, 9 aa, Homo Sapiens
AHVLPQAQL

SEQ ID NO: 1387396 - protein, 9 aa, Homo Sapiens
YTVRVPGSE

SEQ ID NO: 1387397 - protein, 9 aa, Homo Sapiens
AKRWEPFRK

SEQ ID NO: 1387398 - protein, 9 aa, Homo Sapiens
CSSGSCPSL

SEQ ID NO: 1387399 - protein, 9 aa, Homo Sapiens
QDLLGLFFL

SEQ ID NO: 1387400 - protein, 9 aa, Homo Sapiens
SRIPSAPWM

SEQ ID NO: 1387401 - protein, 9 aa, Homo Sapiens
ATSAAGAQP

SEQ ID NO: 1387402 - protein, 9 aa, Homo Sapiens
TTEPVIPKD

SEQ ID NO: 1387403 - protein, 9 aa, Homo Sapiens
GDRGLQGPP

SEQ ID NO: 1387404 - protein, 9 aa, Homo Sapiens
LPRRRLCQT

SEQ ID NO: 1387405 - protein, 9 aa, Homo Sapiens
QASLIDGVG

SEQ ID NO: 1387406 - protein, 9 aa, Homo Sapiens
WKNPALWDL

SEQ ID NO: 1387407 - protein, 9 aa, Homo Sapiens
WDRIVLGRA

SEQ ID NO: 1387408 - protein, 9 aa, Homo Sapiens
LGNGDFQMV

SEQ ID NO: 1387409 - protein, 9 aa, Homo Sapiens
DGGANSDSS

SEQ ID NO: 1387410 - protein, 9 aa, Homo Sapiens
PFLVTLITI

SEQ ID NO: 1387411 - protein, 9 aa, Homo Sapiens
PGAPFLRGL

SEQ ID NO: 1387412 - protein, 9 aa, Homo Sapiens
PLQLLWLGA

SEQ ID NO: 1387413 - protein, 9 aa, Homo Sapiens
QSFFFFFLF

SEQ ID NO: 1387414 - protein, 9 aa, Homo Sapiens
ELEDWIEDM

SEQ ID NO: 1387415 - protein, 9 aa, Homo Sapiens
SSAYQTEGT

SEQ ID NO: 1387416 - protein, 9 aa, Homo Sapiens
WVSCCYVRL

SEQ ID NO: 1387417 - protein, 9 aa, Homo Sapiens
VGLLEGSAE

SEQ ID NO: 1387418 - protein, 9 aa, Homo Sapiens
FISDDESFN

SEQ ID NO: 1387419 - protein, 9 aa, Homo Sapiens
STSKGDEKG

SEQ ID NO: 1387420 - protein, 9 aa, Homo Sapiens
SLTCHFHVT

SEQ ID NO: 1387421 - protein, 9 aa, Homo Sapiens
GFLEPGEAA

SEQ ID NO: 1387422 - protein, 9 aa, Homo Sapiens
THCTVAVPK

SEQ ID NO: 1387423 - protein, 9 aa, Homo Sapiens
WKLQTHPSL

SEQ ID NO: 1387424 - protein, 9 aa, Homo Sapiens
TPTEPPLPT

SEQ ID NO: 1387425 - protein, 9 aa, Homo Sapiens
MPDQLYRTE

SEQ ID NO: 1387426 - protein, 9 aa, Homo Sapiens
KDRGKAFIL

SEQ ID NO: 1387427 - protein, 9 aa, Homo Sapiens
DEDFSITED

SEQ ID NO: 1387428 - protein, 9 aa, Homo Sapiens
AVCVAGVHY

SEQ ID NO: 1387429 - protein, 9 aa, Homo Sapiens
MRRNLRNDL

SEQ ID NO: 1387430 - protein, 9 aa, Homo Sapiens
SGPATMSPW

SEQ ID NO: 1387431 - protein, 9 aa, Homo Sapiens
WGTLRFVAS

SEQ ID NO: 1387432 - protein, 9 aa, Homo Sapiens
KSRLFRVEF

SEQ ID NO: 1387433 - protein, 9 aa, Homo Sapiens
HSFYHTGGS

SEQ ID NO: 1387434 - protein, 9 aa, Homo Sapiens
CSCSHRRRA

SEQ ID NO: 1387435 - protein, 9 aa, Homo Sapiens
IPNTFKYPR

SEQ ID NO: 1387436 - protein, 9 aa, Homo Sapiens
YPMFTEKEM

SEQ ID NO: 1387437 - protein, 9 aa, Homo Sapiens
LGKYKEVVA

SEQ ID NO: 1387438 - protein, 9 aa, Homo Sapiens
LGWGVGGVE

SEQ ID NO: 1387439 - protein, 9 aa, Homo Sapiens
IKEPNSKNS

SEQ ID NO: 1387440 - protein, 9 aa, Homo Sapiens
LMVLLKTNW

SEQ ID NO: 1387441 - protein, 9 aa, Homo Sapiens
RQLRKQKKE

SEQ ID NO: 1387442 - protein, 9 aa, Homo Sapiens
MGARAPAPT

SEQ ID NO: 1387443 - protein, 9 aa, Homo Sapiens
ELLSEKKFL

SEQ ID NO: 1387444 - protein, 9 aa, Homo Sapiens
SSDSLCSHR

SEQ ID NO: 1387445 - protein, 9 aa, Homo Sapiens
GSWYTVRVP

SEQ ID NO: 1387446 - protein, 9 aa, Homo Sapiens
RNFIGDRNI

SEQ ID NO: 1387447 - protein, 9 aa, Homo Sapiens
APWMPCTTS

SEQ ID NO: 1387448 - protein, 9 aa, Homo Sapiens
ITRGMKMYV

SEQ ID NO: 1387449 - protein, 9 aa, Homo Sapiens
EGSCFPKNL

SEQ ID NO: 1387450 - protein, 9 aa, Homo Sapiens
EALEKLHSE

SEQ ID NO: 1387451 - protein, 9 aa, Homo Sapiens
AIRSSPKLF

SEQ ID NO: 1387452 - protein, 9 aa, Homo Sapiens
RHVFGKSDE

SEQ ID NO: 1387453 - protein, 9 aa, Homo Sapiens
LISGVEIHC

SEQ ID NO: 1387454 - protein, 9 aa, Homo Sapiens
TVGHQASPT

SEQ ID NO: 1387455 - protein, 9 aa, Homo Sapiens
RPETPKQKK

SEQ ID NO: 1387456 - protein, 9 aa, Homo Sapiens
MPSVTEASP

SEQ ID NO: 1387457 - protein, 9 aa, Homo Sapiens
TCSWQVLQR

SEQ ID NO: 1387458 - protein, 9 aa, Homo Sapiens
VALTSLHPM

SEQ ID NO: 1387459 - protein, 9 aa, Homo Sapiens
LQQGAGVQD

SEQ ID NO: 1387460 - protein, 9 aa, Homo Sapiens
ATGQTKRTR

SEQ ID NO: 1387461 - protein, 9 aa, Homo Sapiens
ELVDTHIHA

SEQ ID NO: 1387462 - protein, 9 aa, Homo Sapiens
AQCVVLEAR

SEQ ID NO: 1387463 - protein, 9 aa, Homo Sapiens
LYSLGRNPT

SEQ ID NO: 1387464 - protein, 9 aa, Homo Sapiens
NINENVINV

SEQ ID NO: 1387465 - protein, 9 aa, Homo Sapiens
LSARMTVTR

SEQ ID NO: 1387466 - protein, 9 aa, Homo Sapiens
HLATAWPHL

SEQ ID NO: 1387467 - protein, 9 aa, Homo Sapiens
LLCSSKSTT

SEQ ID NO: 1387468 - protein, 9 aa, Homo Sapiens
VAADMMVDF

SEQ ID NO: 1387469 - protein, 9 aa, Homo Sapiens
APAPTCVSS

SEQ ID NO: 1387470 - protein, 9 aa, Homo Sapiens
YRERGGGCL

SEQ ID NO: 1387471 - protein, 9 aa, Homo Sapiens
PRPPWALMS

SEQ ID NO: 1387472 - protein, 9 aa, Homo Sapiens
WGPEDGVNP

SEQ ID NO: 1387473 - protein, 9 aa, Homo Sapiens
KVAGGHSGS

SEQ ID NO: 1387474 - protein, 9 aa, Homo Sapiens
PSIQACQIK

SEQ ID NO: 1387475 - protein, 9 aa, Homo Sapiens
WGTLSIAYC

SEQ ID NO: 1387476 - protein, 9 aa, Homo Sapiens
KQLFEKNRS

SEQ ID NO: 1387477 - protein, 9 aa, Homo Sapiens
GKGFVASPG

SEQ ID NO: 1387478 - protein, 9 aa, Homo Sapiens
NPIYSCNVF

SEQ ID NO: 1387479 - protein, 9 aa, Homo Sapiens
SHGPLGDRC

SEQ ID NO: 1387480 - protein, 9 aa, Homo Sapiens
SCCSWSCWS

SEQ ID NO: 1387481 - protein, 9 aa, Homo Sapiens
TTAATSSSG

SEQ ID NO: 1387482 - protein, 9 aa, Homo Sapiens
RKCQKRAPI

SEQ ID NO: 1387483 - protein, 9 aa, Homo Sapiens
WVLRVTDCT

SEQ ID NO: 1387484 - protein, 9 aa, Homo Sapiens
HPEVRSKEQ

SEQ ID NO: 1387485 - protein, 9 aa, Homo Sapiens
DEAIKGLLG

SEQ ID NO: 1387486 - protein, 9 aa, Homo Sapiens
RHRARQLRK

SEQ ID NO: 1387487 - protein, 9 aa, Homo Sapiens
WVEEWYNDS

SEQ ID NO: 1387488 - protein, 9 aa, Homo Sapiens
GSQPWDINA

SEQ ID NO: 1387489 - protein, 9 aa, Homo Sapiens
NKESHVPYW

SEQ ID NO: 1387490 - protein, 9 aa, Homo Sapiens
QRTACDITA

SEQ ID NO: 1387491 - protein, 9 aa, Homo Sapiens
QAALDDYSV

SEQ ID NO: 1387492 - protein, 9 aa, Homo Sapiens
SHTQRQPWV

SEQ ID NO: 1387493 - protein, 9 aa, Homo Sapiens
AVHLAFSPG

SEQ ID NO: 1387494 - protein, 9 aa, Homo Sapiens
RALPLQLLW

SEQ ID NO: 1387495 - protein, 9 aa, Homo Sapiens
AVAAVVVPA

SEQ ID NO: 1387496 - protein, 9 aa, Homo Sapiens
TSAGEGPSR

SEQ ID NO: 1387497 - protein, 9 aa, Homo Sapiens
CCALWGWFS

SEQ ID NO: 1387498 - protein, 9 aa, Homo Sapiens
SYGEDYFHI

SEQ ID NO: 1387499 - protein, 9 aa, Homo Sapiens
ASSSTSRDS

SEQ ID NO: 1387500 - protein, 9 aa, Homo Sapiens
QWFSTPWSP

SEQ ID NO: 1387501 - protein, 9 aa, Homo Sapiens
NSERKGLPF

SEQ ID NO: 1387502 - protein, 9 aa, Homo Sapiens
LGIEIHVSV

SEQ ID NO: 1387503 - protein, 9 aa, Homo Sapiens
AYKGKSPQP

SEQ ID NO: 1387504 - protein, 9 aa, Homo Sapiens
VTRPPAPPT

SEQ ID NO: 1387505 - protein, 9 aa, Homo Sapiens
WGGPCGFPG

SEQ ID NO: 1387506 - protein, 9 aa, Homo Sapiens
KMVLVLVFM

SEQ ID NO: 1387507 - protein, 9 aa, Homo Sapiens
EIMSHYRHL

SEQ ID NO: 1387508 - protein, 9 aa, Homo Sapiens
GSAPRAPPI

SEQ ID NO: 1387509 - protein, 9 aa, Homo Sapiens
GSWPVAQRM

SEQ ID NO: 1387510 - protein, 9 aa, Homo Sapiens
CSSERAGDI

SEQ ID NO: 1387511 - protein, 9 aa, Homo Sapiens
PRHKNKDML

SEQ ID NO: 1387512 - protein, 9 aa, Homo Sapiens
KPLGPKSRG

SEQ ID NO: 1387513 - protein, 9 aa, Homo Sapiens
LQLGMRVRM

SEQ ID NO: 1387514 - protein, 9 aa, Homo Sapiens
KLKHMSHGE

SEQ ID NO: 1387515 - protein, 9 aa, Homo Sapiens
SPSMSTARG

SEQ ID NO: 1387516 - protein, 9 aa, Homo Sapiens
DRGKAFILG

SEQ ID NO: 1387517 - protein, 9 aa, Homo Sapiens
KEVRQAVEK

SEQ ID NO: 1387518 - protein, 9 aa, Homo Sapiens
EIEVSISEN

SEQ ID NO: 1387519 - protein, 9 aa, Homo Sapiens
GGEDQRLCH

SEQ ID NO: 1387520 - protein, 9 aa, Homo Sapiens
SAPQTETRA

SEQ ID NO: 1387521 - protein, 9 aa, Homo Sapiens
EEDDEEAQG

SEQ ID NO: 1387522 - protein, 9 aa, Homo Sapiens
AAACAPGRV

SEQ ID NO: 1387523 - protein, 9 aa, Homo Sapiens
PTQLVLSGE

SEQ ID NO: 1387524 - protein, 9 aa, Homo Sapiens
TGVISWIRQ

SEQ ID NO: 1387525 - protein, 9 aa, Homo Sapiens
TYSALIAGS

SEQ ID NO: 1387526 - protein, 9 aa, Homo Sapiens
RESVHCKGR

SEQ ID NO: 1387527 - protein, 9 aa, Homo Sapiens
VVMIQTFPL

SEQ ID NO: 1387528 - protein, 9 aa, Homo Sapiens
PGRGSLHKT

SEQ ID NO: 1387529 - protein, 9 aa, Homo Sapiens
YAFRDLNYL

SEQ ID NO: 1387530 - protein, 9 aa, Homo Sapiens
TLRFVASLW

SEQ ID NO: 1387531 - protein, 9 aa, Homo Sapiens
VPMGSISVV

SEQ ID NO: 1387532 - protein, 9 aa, Homo Sapiens
GAYSKHTLS

SEQ ID NO: 1387533 - protein, 9 aa, Homo Sapiens
ACLDFLWRV

SEQ ID NO: 1387534 - protein, 9 aa, Homo Sapiens
SQTSSHTNS

SEQ ID NO: 1387535 - protein, 9 aa, Homo Sapiens
KPYECKDRG

SEQ ID NO: 1387536 - protein, 9 aa, Homo Sapiens
PLNPAAQDG

SEQ ID NO: 1387537 - protein, 9 aa, Homo Sapiens
CQMSGTSGK

SEQ ID NO: 1387538 - protein, 9 aa, Homo Sapiens
APHPPNYSM

SEQ ID NO: 1387539 - protein, 9 aa, Homo Sapiens
ASVMALAGF

SEQ ID NO: 1387540 - protein, 9 aa, Homo Sapiens
HPRLDHQAT

SEQ ID NO: 1387541 - protein, 9 aa, Homo Sapiens
LPTASGLKN

SEQ ID NO: 1387542 - protein, 9 aa, Homo Sapiens
DWKPQWLRA

SEQ ID NO: 1387543 - protein, 9 aa, Homo Sapiens
NWVSCCYVR

SEQ ID NO: 1387544 - protein, 9 aa, Homo Sapiens
RAYQSTSGP

SEQ ID NO: 1387545 - protein, 9 aa, Homo Sapiens
PGKELNSVA

SEQ ID NO: 1387546 - protein, 9 aa, Homo Sapiens
DEEEEEMMV

SEQ ID NO: 1387547 - protein, 9 aa, Homo Sapiens
RSSSAWAPQ

SEQ ID NO: 1387548 - protein, 9 aa, Homo Sapiens
PTKKRGKSQ

SEQ ID NO: 1387549 - protein, 9 aa, Homo Sapiens
SLFSNIEST

SEQ ID NO: 1387550 - protein, 9 aa, Homo Sapiens
KTRAPRRCQ

SEQ ID NO: 1387551 - protein, 9 aa, Homo Sapiens
MSPWYRGPT

SEQ ID NO: 1387552 - protein, 9 aa, Homo Sapiens
FPFTSPTIP

SEQ ID NO: 1387553 - protein, 9 aa, Homo Sapiens
LVNMGGNRS

SEQ ID NO: 1387554 - protein, 9 aa, Homo Sapiens
KVYVTSQQI

SEQ ID NO: 1387555 - protein, 9 aa, Homo Sapiens
HCDGVFDCS

SEQ ID NO: 1387556 - protein, 9 aa, Homo Sapiens
VGIWYLFHK

SEQ ID NO: 1387557 - protein, 9 aa, Homo Sapiens
IGDRNICRA

SEQ ID NO: 1387558 - protein, 9 aa, Homo Sapiens
VHPSRSPLW

SEQ ID NO: 1387559 - protein, 9 aa, Homo Sapiens
LSWRGLHSF

SEQ ID NO: 1387560 - protein, 9 aa, Homo Sapiens
TTATCSPSG

SEQ ID NO: 1387561 - protein, 9 aa, Homo Sapiens
IKMLVNGKK

SEQ ID NO: 1387562 - protein, 9 aa, Homo Sapiens
DSALHHRLC

SEQ ID NO: 1387563 - protein, 9 aa, Homo Sapiens
KKSTKPQKN

SEQ ID NO: 1387564 - protein, 9 aa, Homo Sapiens
LLKNILPKS

SEQ ID NO: 1387565 - protein, 9 aa, Homo Sapiens
WKNTRVENV

SEQ ID NO: 1387566 - protein, 9 aa, Homo Sapiens
ISIVLSYIH

SEQ ID NO: 1387567 - protein, 9 aa, Homo Sapiens
KDFNREKMP

SEQ ID NO: 1387568 - protein, 9 aa, Homo Sapiens
FEGCDWRFA

SEQ ID NO: 1387569 - protein, 9 aa, Homo Sapiens
QPPELVSAL

SEQ ID NO: 1387570 - protein, 9 aa, Homo Sapiens
VASLWGWSL

SEQ ID NO: 1387571 - protein, 9 aa, Homo Sapiens
PWWMPSLAR

SEQ ID NO: 1387572 - protein, 9 aa, Homo Sapiens
DDVFNFETF

SEQ ID NO: 1387573 - protein, 9 aa, Homo Sapiens
FIFSTRNNL

SEQ ID NO: 1387574 - protein, 9 aa, Homo Sapiens
EKIINPTIS

SEQ ID NO: 1387575 - protein, 9 aa, Homo Sapiens
GRGSLHKTR

SEQ ID NO: 1387576 - protein, 9 aa, Homo Sapiens
AGGDLAATV

SEQ ID NO: 1387577 - protein, 8 aa, Homo Sapiens
DTFTVQDS

SEQ ID NO: 1387578 - protein, 9 aa, Homo Sapiens
AGSQDVGIW

SEQ ID NO: 1387579 - protein, 9 aa, Homo Sapiens
LVCVPRRPW

SEQ ID NO: 1387580 - protein, 9 aa, Homo Sapiens
QENQEQGKH

SEQ ID NO: 1387581 - protein, 9 aa, Homo Sapiens
ALWGWFSAC

SEQ ID NO: 1387582 - protein, 9 aa, Homo Sapiens
CVAGVHYQA

SEQ ID NO: 1387583 - protein, 9 aa, Homo Sapiens
TLLMLPPIF

SEQ ID NO: 1387584 - protein, 9 aa, Homo Sapiens
IRWDTIIFS

SEQ ID NO: 1387585 - protein, 9 aa, Homo Sapiens
IFKYPSIQA

SEQ ID NO: 1387586 - protein, 9 aa, Homo Sapiens
GGGSFSSNL

SEQ ID NO: 1387587 - protein, 9 aa, Homo Sapiens
VQMVVMIQT

SEQ ID NO: 1387588 - protein, 9 aa, Homo Sapiens
VSQFVTFYS

SEQ ID NO: 1387589 - protein, 9 aa, Homo Sapiens
DKKRGASSS

SEQ ID NO: 1387590 - protein, 9 aa, Homo Sapiens
MQMRRRSQR

SEQ ID NO: 1387591 - protein, 9 aa, Homo Sapiens
VTSQQIFGA

SEQ ID NO: 1387592 - protein, 9 aa, Homo Sapiens
DFRTQESTA

SEQ ID NO: 1387593 - protein, 9 aa, Homo Sapiens
LMTGKDLGP

SEQ ID NO: 1387594 - protein, 9 aa, Homo Sapiens
YPSIQACQI

SEQ ID NO: 1387595 - protein, 9 aa, Homo Sapiens
THHVAADMM

SEQ ID NO: 1387596 - protein, 9 aa, Homo Sapiens
CKGRIHLTT

SEQ ID NO: 1387597 - protein, 9 aa, Homo Sapiens
VSFLKEHLL

SEQ ID NO: 1387598 - protein, 9 aa, Homo Sapiens
MPMVDPEAR

SEQ ID NO: 1387599 - protein, 9 aa, Homo Sapiens
EKLFSMFFS

SEQ ID NO: 1387600 - protein, 9 aa, Homo Sapiens
CVRSAVEQW

SEQ ID NO: 1387601 - protein, 9 aa, Homo Sapiens
REKEHEKDQ

SEQ ID NO: 1387602 - protein, 9 aa, Homo Sapiens
KVTAKKVYV

SEQ ID NO: 1387603 - protein, 9 aa, Homo Sapiens
TFLPKIFRK

SEQ ID NO: 1387604 - protein, 9 aa, Homo Sapiens
LDFYQHNWL

SEQ ID NO: 1387605 - protein, 9 aa, Homo Sapiens
SVVTPAQDG

SEQ ID NO: 1387606 - protein, 9 aa, Homo Sapiens
VRVHPDLGV

SEQ ID NO: 1387607 - protein, 9 aa, Homo Sapiens
VVHPSRSPL

SEQ ID NO: 1387608 - protein, 9 aa, Homo Sapiens
GTLGLVVSL

SEQ ID NO: 1387609 - protein, 9 aa, Homo Sapiens
GLETQKHWA

SEQ ID NO: 1387610 - protein, 9 aa, Homo Sapiens
GWQKRTQTC

SEQ ID NO: 1387611 - protein, 9 aa, Homo Sapiens
VDAQPKKKA

SEQ ID NO: 1387612 - protein, 9 aa, Homo Sapiens
ALWCGHELP

SEQ ID NO: 1387613 - protein, 9 aa, Homo Sapiens
RLLIPECFN

SEQ ID NO: 1387614 - protein, 9 aa, Homo Sapiens
MYVKVFYAF

SEQ ID NO: 1387615 - protein, 9 aa, Homo Sapiens
AHLACPEAW

SEQ ID NO: 1387616 - protein, 9 aa, Homo Sapiens
SVKQDSDSK

SEQ ID NO: 1387617 - protein, 9 aa, Homo Sapiens
DPVPYSANL

SEQ ID NO: 1387618 - protein, 9 aa, Homo Sapiens
PVTANITAT

SEQ ID NO: 1387619 - protein, 9 aa, Homo Sapiens
WPERIHQSP

SEQ ID NO: 1387620 - protein, 9 aa, Homo Sapiens
IPHVHVSFG

SEQ ID NO: 1387621 - protein, 9 aa, Homo Sapiens
TTAETQDVQ

SEQ ID NO: 1387622 - protein, 9 aa, Homo Sapiens
NLLRLQSLL

SEQ ID NO: 1387623 - protein, 9 aa, Homo Sapiens
PRRCQRKAQ

SEQ ID NO: 1387624 - protein, 9 aa, Homo Sapiens
QRTSAGCST

SEQ ID NO: 1387625 - protein, 9 aa, Homo Sapiens
APSAPVSGG

SEQ ID NO: 1387626 - protein, 9 aa, Homo Sapiens
GLDSGADTG

SEQ ID NO: 1387627 - protein, 9 aa, Homo Sapiens
PVVRPRSLR

SEQ ID NO: 1387628 - protein, 9 aa, Homo Sapiens
KMEFRTSMK

SEQ ID NO: 1387629 - protein, 9 aa, Homo Sapiens
KQTAPKMLG

SEQ ID NO: 1387630 - protein, 9 aa, Homo Sapiens
PPTTQPDDN

SEQ ID NO: 1387631 - protein, 9 aa, Homo Sapiens
LSYIHIFST

SEQ ID NO: 1387632 - protein, 9 aa, Homo Sapiens
PRALLTQPP

SEQ ID NO: 1387633 - protein, 9 aa, Homo Sapiens
VRLSAVGLS

SEQ ID NO: 1387634 - protein, 9 aa, Homo Sapiens
QAQLQGFLI

SEQ ID NO: 1387635 - protein, 9 aa, Homo Sapiens
TYSVKQDSD

SEQ ID NO: 1387636 - protein, 9 aa, Homo Sapiens
LDKKNRVLE

SEQ ID NO: 1387637 - protein, 9 aa, Homo Sapiens
VGLVHEALQ

SEQ ID NO: 1387638 - protein, 9 aa, Homo Sapiens
TVNREPFTM

SEQ ID NO: 1387639 - protein, 9 aa, Homo Sapiens
DHPSMHILS

SEQ ID NO: 1387640 - protein, 9 aa, Homo Sapiens
KKKPYECTL

SEQ ID NO: 1387641 - protein, 9 aa, Homo Sapiens
PDSSAPHPP

SEQ ID NO: 1387642 - protein, 9 aa, Homo Sapiens
SQNQRGLAS

SEQ ID NO: 1387643 - protein, 9 aa, Homo Sapiens
WVAALEGHR

SEQ ID NO: 1387644 - protein, 9 aa, Homo Sapiens
GRVSEEIFG

SEQ ID NO: 1387645 - protein, 9 aa, Homo Sapiens
GSQVHSPCI

SEQ ID NO: 1387646 - protein, 9 aa, Homo Sapiens
SYRSSQCSS

SEQ ID NO: 1387647 - protein, 9 aa, Homo Sapiens
QSISFSDLP

SEQ ID NO: 1387648 - protein, 9 aa, Homo Sapiens
NVGTSSSAV

SEQ ID NO: 1387649 - protein, 9 aa, Homo Sapiens
GDYQTGFPF

SEQ ID NO: 1387650 - protein, 9 aa, Homo Sapiens
KEDMEIMSH

SEQ ID NO: 1387651 - protein, 9 aa, Homo Sapiens
RLQSECQKT

SEQ ID NO: 1387652 - protein, 9 aa, Homo Sapiens
PLSFLQCLT

SEQ ID NO: 1387653 - protein, 9 aa, Homo Sapiens
QKVLNWSLF

SEQ ID NO: 1387654 - protein, 9 aa, Homo Sapiens
WLRKCAKIT

SEQ ID NO: 1387655 - protein, 9 aa, Homo Sapiens
EADLVIFHF

SEQ ID NO: 1387656 - protein, 9 aa, Homo Sapiens
GAWLAVSYA

SEQ ID NO: 1387657 - protein, 9 aa, Homo Sapiens
QGWGWGAWL

SEQ ID NO: 1387658 - protein, 9 aa, Homo Sapiens
DNCQPTNVS

SEQ ID NO: 1387659 - protein, 9 aa, Homo Sapiens
RDHAAALPG

SEQ ID NO: 1387660 - protein, 9 aa, Homo Sapiens
GPPPRPPSH

SEQ ID NO: 1387661 - protein, 9 aa, Homo Sapiens
TKISRKMRN

SEQ ID NO: 1387662 - protein, 9 aa, Homo Sapiens
HRNEELNME

SEQ ID NO: 1387663 - protein, 9 aa, Homo Sapiens
DKRMDSIKP

SEQ ID NO: 1387664 - protein, 9 aa, Homo Sapiens
FGGRGTTDR

SEQ ID NO: 1387665 - protein, 9 aa, Homo Sapiens
EIHCEEKGR

SEQ ID NO: 1387666 - protein, 9 aa, Homo Sapiens
AREEPLESS

SEQ ID NO: 1387667 - protein, 9 aa, Homo Sapiens
PSAPWMPCT

SEQ ID NO: 1387668 - protein, 9 aa, Homo Sapiens
AATLRCPAV

SEQ ID NO: 1387669 - protein, 9 aa, Homo Sapiens
KISRKMRNP

SEQ ID NO: 1387670 - protein, 9 aa, Homo Sapiens
IAIKLGSSK

SEQ ID NO: 1387671 - protein, 9 aa, Homo Sapiens
TRQDVQSLL

SEQ ID NO: 1387672 - protein, 9 aa, Homo Sapiens
LPVTAFIIP

SEQ ID NO: 1387673 - protein, 9 aa, Homo Sapiens
PTHARTTAS

SEQ ID NO: 1387674 - protein, 9 aa, Homo Sapiens
TKMILTKQI

SEQ ID NO: 1387675 - protein, 9 aa, Homo Sapiens
TEAEEGSWS

SEQ ID NO: 1387676 - protein, 9 aa, Homo Sapiens
WSPVVRPRS

SEQ ID NO: 1387677 - protein, 9 aa, Homo Sapiens
TTHKNSYWR

SEQ ID NO: 1387678 - protein, 9 aa, Homo Sapiens
CMGGGLALW

SEQ ID NO: 1387679 - protein, 9 aa, Homo Sapiens
LCLPMIVGS

SEQ ID NO: 1387680 - protein, 9 aa, Homo Sapiens
QQLHHGSQY

SEQ ID NO: 1387681 - protein, 9 aa, Homo Sapiens
TNKLTFSFS

SEQ ID NO: 1387682 - protein, 9 aa, Homo Sapiens
PSVSISPSS

SEQ ID NO: 1387683 - protein, 9 aa, Homo Sapiens
TLSQPPPQA

SEQ ID NO: 1387684 - protein, 9 aa, Homo Sapiens
THFYLDQWT

SEQ ID NO: 1387685 - protein, 9 aa, Homo Sapiens
STLGDVYVN

SEQ ID NO: 1387686 - protein, 9 aa, Homo Sapiens
SYTLEDQDW

SEQ ID NO: 1387687 - protein, 9 aa, Homo Sapiens
THSPADDPL

SEQ ID NO: 1387688 - protein, 9 aa, Homo Sapiens
GLVLPKKIC

SEQ ID NO: 1387689 - protein, 9 aa, Homo Sapiens
PSMSTARGL

SEQ ID NO: 1387690 - protein, 9 aa, Homo Sapiens
FTKHLFREL

SEQ ID NO: 1387691 - protein, 9 aa, Homo Sapiens
IFRKMSSSG

SEQ ID NO: 1387692 - protein, 9 aa, Homo Sapiens
SQPWDINAV

SEQ ID NO: 1387693 - protein, 9 aa, Homo Sapiens
ESKLNNKYL

SEQ ID NO: 1387694 - protein, 9 aa, Homo Sapiens
GGPKAHWKL

SEQ ID NO: 1387695 - protein, 9 aa, Homo Sapiens
QQRQDNCQP

SEQ ID NO: 1387696 - protein, 9 aa, Homo Sapiens
GVGDPKIGV

SEQ ID NO: 1387697 - protein, 9 aa, Homo Sapiens
SKQTAPKML

SEQ ID NO: 1387698 - protein, 9 aa, Homo Sapiens
HQRRSAHKE

SEQ ID NO: 1387699 - protein, 9 aa, Homo Sapiens
RRLCQTQAN

SEQ ID NO: 1387700 - protein, 9 aa, Homo Sapiens
PCGFPGGGG

SEQ ID NO: 1387701 - protein, 9 aa, Homo Sapiens
RSKTRGKNF

SEQ ID NO: 1387702 - protein, 9 aa, Homo Sapiens
HLYHWHPSC

SEQ ID NO: 1387703 - protein, 9 aa, Homo Sapiens
TPSTDLKIR

SEQ ID NO: 1387704 - protein, 9 aa, Homo Sapiens
NTVQLHGMR

SEQ ID NO: 1387705 - protein, 9 aa, Homo Sapiens
VLTFNNLTR

SEQ ID NO: 1387706 - protein, 9 aa, Homo Sapiens
KIINPTISC

SEQ ID NO: 1387707 - protein, 9 aa, Homo Sapiens
SDSLCSHRG

SEQ ID NO: 1387708 - protein, 9 aa, Homo Sapiens
CWGDISREE

SEQ ID NO: 1387709 - protein, 9 aa, Homo Sapiens
ISGHVRVHP

SEQ ID NO: 1387710 - protein, 9 aa, Homo Sapiens
PRESMTLLF

SEQ ID NO: 1387711 - protein, 9 aa, Homo Sapiens
NWGSLPLRS

SEQ ID NO: 1387712 - protein, 9 aa, Homo Sapiens
LDRGCNWTP

SEQ ID NO: 1387713 - protein, 9 aa, Homo Sapiens
DSGEVQQVQ

SEQ ID NO: 1387714 - protein, 9 aa, Homo Sapiens
LWTRQRIFI

SEQ ID NO: 1387715 - protein, 9 aa, Homo Sapiens
PPVTSQEAM

SEQ ID NO: 1387716 - protein, 9 aa, Homo Sapiens
MRLTDVQQL

SEQ ID NO: 1387717 - protein, 9 aa, Homo Sapiens
CPQASWNLS

SEQ ID NO: 1387718 - protein, 9 aa, Homo Sapiens
LGDEVFDRK

SEQ ID NO: 1387719 - protein, 9 aa, Homo Sapiens
AWHPGSWPV

SEQ ID NO: 1387720 - protein, 9 aa, Homo Sapiens
VIRNVAKDG

SEQ ID NO: 1387721 - protein, 9 aa, Homo Sapiens
MTKKRVNTA

SEQ ID NO: 1387722 - protein, 9 aa, Homo Sapiens
VVAQYQMII

SEQ ID NO: 1387723 - protein, 9 aa, Homo Sapiens
APVELRHVF

SEQ ID NO: 1387724 - protein, 9 aa, Homo Sapiens
MDGWLRNPD

SEQ ID NO: 1387725 - protein, 9 aa, Homo Sapiens
LKGLEENLL

SEQ ID NO: 1387726 - protein, 9 aa, Homo Sapiens
SSDSSSNSS

SEQ ID NO: 1387727 - protein, 9 aa, Homo Sapiens
WRGNTRKQA

SEQ ID NO: 1387728 - protein, 9 aa, Homo Sapiens
VGLLGAGPS

SEQ ID NO: 1387729 - protein, 9 aa, Homo Sapiens
SLGRPGREP

SEQ ID NO: 1387730 - protein, 9 aa, Homo Sapiens
EVATQMQSF

SEQ ID NO: 1387731 - protein, 9 aa, Homo Sapiens
NVALTSLHP

SEQ ID NO: 1387732 - protein, 9 aa, Homo Sapiens
DETAFFTNK

SEQ ID NO: 1387733 - protein, 9 aa, Homo Sapiens
VIEEHFGPD

SEQ ID NO: 1387734 - protein, 9 aa, Homo Sapiens
WRRWGTLGL

SEQ ID NO: 1387735 - protein, 9 aa, Homo Sapiens
RDGGSPPLD

SEQ ID NO: 1387736 - protein, 9 aa, Homo Sapiens
NSSVSSSPS

SEQ ID NO: 1387737 - protein, 9 aa, Homo Sapiens
HWHPSCLTP

SEQ ID NO: 1387738 - protein, 9 aa, Homo Sapiens
WIEDMLSGK

SEQ ID NO: 1387739 - protein, 9 aa, Homo Sapiens
DGCPVWYNI

SEQ ID NO: 1387740 - protein, 9 aa, Homo Sapiens
NPSNRSLPH

SEQ ID NO: 1387741 - protein, 9 aa, Homo Sapiens
NFRKEKNSR

SEQ ID NO: 1387742 - protein, 9 aa, Homo Sapiens
RGWQKRTQT

SEQ ID NO: 1387743 - protein, 9 aa, Homo Sapiens
VILKHFRVL

SEQ ID NO: 1387744 - protein, 9 aa, Homo Sapiens
ACGRGALRN

SEQ ID NO: 1387745 - protein, 9 aa, Homo Sapiens
DDMAMCFIK

SEQ ID NO: 1387746 - protein, 9 aa, Homo Sapiens
CPRAYQSTS

SEQ ID NO: 1387747 - protein, 9 aa, Homo Sapiens
KTIRNQGSI

SEQ ID NO: 1387748 - protein, 9 aa, Homo Sapiens
AGAGGRSGR

SEQ ID NO: 1387749 - protein, 9 aa, Homo Sapiens
QVHSPCINP

SEQ ID NO: 1387750 - protein, 9 aa, Homo Sapiens
DTIPNINFQ

SEQ ID NO: 1387751 - protein, 9 aa, Homo Sapiens
RCVRLLGIF

SEQ ID NO: 1387752 - protein, 9 aa, Homo Sapiens
GGISPPFPS

SEQ ID NO: 1387753 - protein, 9 aa, Homo Sapiens
RAGASGARH

SEQ ID NO: 1387754 - protein, 9 aa, Homo Sapiens
TGAMKVQSQ

SEQ ID NO: 1387755 - protein, 9 aa, Homo Sapiens
YIEELQPAL

SEQ ID NO: 1387756 - protein, 9 aa, Homo Sapiens
PPQAPSQVW

SEQ ID NO: 1387757 - protein, 9 aa, Homo Sapiens
SYYEQKNSS

SEQ ID NO: 1387758 - protein, 9 aa, Homo Sapiens
SFFTSAHPS

SEQ ID NO: 1387759 - protein, 9 aa, Homo Sapiens
MLTDSGNVQ

SEQ ID NO: 1387760 - protein, 9 aa, Homo Sapiens
AHKQAKACP

SEQ ID NO: 1387761 - protein, 9 aa, Homo Sapiens
RYGGTRLFT

SEQ ID NO: 1387762 - protein, 9 aa, Homo Sapiens
RQDNCQPTN

SEQ ID NO: 1387763 - protein, 9 aa, Homo Sapiens
PPTKKRGKS

SEQ ID NO: 1387764 - protein, 9 aa, Homo Sapiens
KRAPINSAQ

SEQ ID NO: 1387765 - protein, 9 aa, Homo Sapiens
LQTTQVNAW

SEQ ID NO: 1387766 - protein, 9 aa, Homo Sapiens
DPGMDTALG

SEQ ID NO: 1387767 - protein, 9 aa, Homo Sapiens
HGPSLPQEQ

SEQ ID NO: 1387768 - protein, 9 aa, Homo Sapiens
QSTGSAPRA

SEQ ID NO: 1387769 - protein, 9 aa, Homo Sapiens
EGTTVSYEI

SEQ ID NO: 1387770 - protein, 9 aa, Homo Sapiens
TASSSKSFI

SEQ ID NO: 1387771 - protein, 9 aa, Homo Sapiens
TLQAIACDA

SEQ ID NO: 1387772 - protein, 9 aa, Homo Sapiens
VSQVNRIDE

SEQ ID NO: 1387773 - protein, 9 aa, Homo Sapiens
ADQKTAIPT

SEQ ID NO: 1387774 - protein, 9 aa, Homo Sapiens
MQETKKKRN

SEQ ID NO: 1387775 - protein, 9 aa, Homo Sapiens
MLDLAGSIL

SEQ ID NO: 1387776 - protein, 9 aa, Homo Sapiens
LMGLCVDMN

SEQ ID NO: 1387777 - protein, 9 aa, Homo Sapiens
ASKRPWSQK

SEQ ID NO: 1387778 - protein, 9 aa, Homo Sapiens
EEYQLFKEL

SEQ ID NO: 1387779 - protein, 9 aa, Homo Sapiens
EKMPLMIFA

SEQ ID NO: 1387780 - protein, 9 aa, Homo Sapiens
QKNECTGKH

SEQ ID NO: 1387781 - protein, 9 aa, Homo Sapiens
HHPLGDTPQ

SEQ ID NO: 1387782 - protein, 9 aa, Homo Sapiens
GKMHGTVDC

SEQ ID NO: 1387783 - protein, 9 aa, Homo Sapiens
ELQVLVMVN

SEQ ID NO: 1387784 - protein, 9 aa, Homo Sapiens
SAPWMPCTT

SEQ ID NO: 1387785 - protein, 9 aa, Homo Sapiens
LCCGKVSFQ

SEQ ID NO: 1387786 - protein, 9 aa, Homo Sapiens
IEDMLSGKI

SEQ ID NO: 1387787 - protein, 9 aa, Homo Sapiens
SPVVRPRSL

SEQ ID NO: 1387788 - protein, 9 aa, Homo Sapiens
ERAGASGAR

SEQ ID NO: 1387789 - protein, 9 aa, Homo Sapiens
TLPQEFAAL

SEQ ID NO: 1387790 - protein, 9 aa, Homo Sapiens
RTPTLREKS

SEQ ID NO: 1387791 - protein, 9 aa, Homo Sapiens
EPDGDYQTG

SEQ ID NO: 1387792 - protein, 9 aa, Homo Sapiens
DANKINCLR

SEQ ID NO: 1387793 - protein, 9 aa, Homo Sapiens
CGATFETTF

SEQ ID NO: 1387794 - protein, 9 aa, Homo Sapiens
MVPYGLSNY

SEQ ID NO: 1387795 - protein, 9 aa, Homo Sapiens
TRCLRMRPP

SEQ ID NO: 1387796 - protein, 9 aa, Homo Sapiens
GNTALHITS

SEQ ID NO: 1387797 - protein, 9 aa, Homo Sapiens
VLNWSLFTG

SEQ ID NO: 1387798 - protein, 9 aa, Homo Sapiens
LTCRCTTPP

SEQ ID NO: 1387799 - protein, 9 aa, Homo Sapiens
CVVYTGDVN

SEQ ID NO: 1387800 - protein, 9 aa, Homo Sapiens
YFLLQTTQV

SEQ ID NO: 1387801 - protein, 9 aa, Homo Sapiens
GQKVKEQKG

SEQ ID NO: 1387802 - protein, 9 aa, Homo Sapiens
GSEFLLLWM

SEQ ID NO: 1387803 - protein, 9 aa, Homo Sapiens
VKLDRLGEG

SEQ ID NO: 1387804 - protein, 9 aa, Homo Sapiens
GTYIIFFSP

SEQ ID NO: 1387805 - protein, 9 aa, Homo Sapiens
CMEGWMGPK

SEQ ID NO: 1387806 - protein, 9 aa, Homo Sapiens
ARDRSVHNL

SEQ ID NO: 1387807 - protein, 9 aa, Homo Sapiens
KRVGKIPDK

SEQ ID NO: 1387808 - protein, 9 aa, Homo Sapiens
LLGLLILLG

SEQ ID NO: 1387809 - protein, 9 aa, Homo Sapiens
APWLPMRSL

SEQ ID NO: 1387810 - protein, 9 aa, Homo Sapiens
ERYGGTRLF

SEQ ID NO: 1387811 - protein, 9 aa, Homo Sapiens
WTIVPLTMG

SEQ ID NO: 1387812 - protein, 9 aa, Homo Sapiens
EGEMRGVFL

SEQ ID NO: 1387813 - protein, 9 aa, Homo Sapiens
YPEKILSDL

SEQ ID NO: 1387814 - protein, 9 aa, Homo Sapiens
GLVASLWGW

SEQ ID NO: 1387815 - protein, 9 aa, Homo Sapiens
IDTDYMLSE

SEQ ID NO: 1387816 - protein, 9 aa, Homo Sapiens
VAQLRRQVR

SEQ ID NO: 1387817 - protein, 9 aa, Homo Sapiens
PTLSKKNPG

SEQ ID NO: 1387818 - protein, 9 aa, Homo Sapiens
KQTQFLRSV

SEQ ID NO: 1387819 - protein, 9 aa, Homo Sapiens
EQMVPYGLS

SEQ ID NO: 1387820 - protein, 9 aa, Homo Sapiens
ATTAETQDV

SEQ ID NO: 1387821 - protein, 9 aa, Homo Sapiens
FQSVLDMLH

SEQ ID NO: 1387822 - protein, 9 aa, Homo Sapiens
LTTLSWTLW

SEQ ID NO: 1387823 - protein, 9 aa, Homo Sapiens
LHISQAMRY

SEQ ID NO: 1387824 - protein, 9 aa, Homo Sapiens
CSSKSTTEV

SEQ ID NO: 1387825 - protein, 9 aa, Homo Sapiens
VENSAQGIR

SEQ ID NO: 1387826 - protein, 9 aa, Homo Sapiens
CSTSFLWAQ

SEQ ID NO: 1387827 - protein, 9 aa, Homo Sapiens
EWEIRLAQE

SEQ ID NO: 1387828 - protein, 9 aa, Homo Sapiens
CHPAWLSPI

SEQ ID NO: 1387829 - protein, 9 aa, Homo Sapiens
TISSSVIEQ

SEQ ID NO: 1387830 - protein, 9 aa, Homo Sapiens
TIMGYDRYV

SEQ ID NO: 1387831 - protein, 9 aa, Homo Sapiens
EWLLAMLEQ

SEQ ID NO: 1387832 - protein, 9 aa, Homo Sapiens
GAYCVQRCT

SEQ ID NO: 1387833 - protein, 9 aa, Homo Sapiens
DRNPHFQNK

SEQ ID NO: 1387834 - protein, 9 aa, Homo Sapiens
PKKCPLLLV

SEQ ID NO: 1387835 - protein, 9 aa, Homo Sapiens
PRGPAAPTS

SEQ ID NO: 1387836 - protein, 9 aa, Homo Sapiens
FTLLVSQVI

SEQ ID NO: 1387837 - protein, 9 aa, Homo Sapiens
CSSWLRRIE

SEQ ID NO: 1387838 - protein, 9 aa, Homo Sapiens
TLDQICLKK

SEQ ID NO: 1387839 - protein, 9 aa, Homo Sapiens
NIAVIIYIF

SEQ ID NO: 1387840 - protein, 9 aa, Homo Sapiens
TRMRQVRCP

SEQ ID NO: 1387841 - protein, 9 aa, Homo Sapiens
FWACGRGAL

SEQ ID NO: 1387842 - protein, 9 aa, Homo Sapiens
VFQIFDNMK

SEQ ID NO: 1387843 - protein, 9 aa, Homo Sapiens
FCFKLMVLL

SEQ ID NO: 1387844 - protein, 9 aa, Homo Sapiens
TRYIYLLVR

SEQ ID NO: 1387845 - protein, 9 aa, Homo Sapiens
PKAHWKLQT

SEQ ID NO: 1387846 - protein, 9 aa, Homo Sapiens
ATVLMIISL

SEQ ID NO: 1387847 - protein, 9 aa, Homo Sapiens
TPGAVHLAF

SEQ ID NO: 1387848 - protein, 9 aa, Homo Sapiens
RKEAELCQV

SEQ ID NO: 1387849 - protein, 9 aa, Homo Sapiens
FRVLQHLSD

SEQ ID NO: 1387850 - protein, 9 aa, Homo Sapiens
DLKIRGKLG

SEQ ID NO: 1387851 - protein, 9 aa, Homo Sapiens
AFSPGHSLE

SEQ ID NO: 1387852 - protein, 9 aa, Homo Sapiens
LFRVEFSGE

SEQ ID NO: 1387853 - protein, 9 aa, Homo Sapiens
DQRHRARQL

SEQ ID NO: 1387854 - protein, 9 aa, Homo Sapiens
RGPAAWKKR

SEQ ID NO: 1387855 - protein, 9 aa, Homo Sapiens
AIGSISGHV

SEQ ID NO: 1387856 - protein, 9 aa, Homo Sapiens
QQLIEDIVC

SEQ ID NO: 1387857 - protein, 9 aa, Homo Sapiens
QWTPTKYLN

SEQ ID NO: 1387858 - protein, 9 aa, Homo Sapiens
VRIVKNWVS

SEQ ID NO: 1387859 - protein, 9 aa, Homo Sapiens
QNLYLLILR

SEQ ID NO: 1387860 - protein, 9 aa, Homo Sapiens
SWKQSQQSL

SEQ ID NO: 1387861 - protein, 9 aa, Homo Sapiens
LKKGIKIYQ

SEQ ID NO: 1387862 - protein, 9 aa, Homo Sapiens
PHCSPARER

SEQ ID NO: 1387863 - protein, 9 aa, Homo Sapiens
DKKNRVLEV

SEQ ID NO: 1387864 - protein, 9 aa, Homo Sapiens
SSPAAACAP

SEQ ID NO: 1387865 - protein, 9 aa, Homo Sapiens
ASSVLQGHV

SEQ ID NO: 1387866 - protein, 9 aa, Homo Sapiens
LHQATRKHI

SEQ ID NO: 1387867 - protein, 9 aa, Homo Sapiens
EDEHFELDV

SEQ ID NO: 1387868 - protein, 9 aa, Homo Sapiens
GAWTLTMPP

SEQ ID NO: 1387869 - protein, 9 aa, Homo Sapiens
HLQNSTLMA

SEQ ID NO: 1387870 - protein, 9 aa, Homo Sapiens
SCPSLYWEW

SEQ ID NO: 1387871 - protein, 9 aa, Homo Sapiens
RTISSSVIE

SEQ ID NO: 1387872 - protein, 9 aa, Homo Sapiens
CLLCPGETY

SEQ ID NO: 1387873 - protein, 9 aa, Homo Sapiens
DYFHIYTDK

SEQ ID NO: 1387874 - protein, 9 aa, Homo Sapiens
MQLQALAMW

SEQ ID NO: 1387875 - protein, 9 aa, Homo Sapiens
PPACRLHAE

SEQ ID NO: 1387876 - protein, 9 aa, Homo Sapiens
NQRGLASVG

SEQ ID NO: 1387877 - protein, 9 aa, Homo Sapiens
GEPGIPGDR

SEQ ID NO: 1387878 - protein, 9 aa, Homo Sapiens
DQDCDKIKQ

SEQ ID NO: 1387879 - protein, 9 aa, Homo Sapiens
ASQTQIPQY

SEQ ID NO: 1387880 - protein, 9 aa, Homo Sapiens
EAEEDDDEE

SEQ ID NO: 1387881 - protein, 9 aa, Homo Sapiens
SLQDAEWCW

SEQ ID NO: 1387882 - protein, 9 aa, Homo Sapiens
ADGLDSGAD

SEQ ID NO: 1387883 - protein, 9 aa, Homo Sapiens
INKITDEAF

SEQ ID NO: 1387884 - protein, 9 aa, Homo Sapiens
SSACSIAMD

SEQ ID NO: 1387885 - protein, 9 aa, Homo Sapiens
SSCSTPPCW

SEQ ID NO: 1387886 - protein, 9 aa, Homo Sapiens
VRLLGIFKV

SEQ ID NO: 1387887 - protein, 9 aa, Homo Sapiens
WKTKKTSFS

SEQ ID NO: 1387888 - protein, 9 aa, Homo Sapiens
WMPCTTSHL

SEQ ID NO: 1387889 - protein, 9 aa, Homo Sapiens
ITTLEKHYL

SEQ ID NO: 1387890 - protein, 9 aa, Homo Sapiens
LQLLLLDAN

SEQ ID NO: 1387891 - protein, 9 aa, Homo Sapiens
QLCLLCPGE

SEQ ID NO: 1387892 - protein, 9 aa, Homo Sapiens
ESGMSQTVT

SEQ ID NO: 1387893 - protein, 9 aa, Homo Sapiens
LLEGSAEIP

SEQ ID NO: 1387894 - protein, 9 aa, Homo Sapiens
QQGAGVQDG

SEQ ID NO: 1387895 - protein, 9 aa, Homo Sapiens
SCMGGGLAL

SEQ ID NO: 1387896 - protein, 9 aa, Homo Sapiens
CWRPPSPWN

SEQ ID NO: 1387897 - protein, 9 aa, Homo Sapiens
TGWEEEDDV

SEQ ID NO: 1387898 - protein, 9 aa, Homo Sapiens
MIQKVILWD

SEQ ID NO: 1387899 - protein, 9 aa, Homo Sapiens
PSPWNRGSC

SEQ ID NO: 1387900 - protein, 9 aa, Homo Sapiens
TGRLMTRSL

SEQ ID NO: 1387901 - protein, 9 aa, Homo Sapiens
DTLQLGMRV

SEQ ID NO: 1387902 - protein, 9 aa, Homo Sapiens
SECQKTVPP

SEQ ID NO: 1387903 - protein, 9 aa, Homo Sapiens
AGIVRRGRA

SEQ ID NO: 1387904 - protein, 9 aa, Homo Sapiens
YRPLVLTVL

SEQ ID NO: 1387905 - protein, 9 aa, Homo Sapiens
AKEFLGSPK

SEQ ID NO: 1387906 - protein, 9 aa, Homo Sapiens
SLKDSRPLC

SEQ ID NO: 1387907 - protein, 9 aa, Homo Sapiens
HGTSHQPAA

SEQ ID NO: 1387908 - protein, 9 aa, Homo Sapiens
QMDEDFSIT

SEQ ID NO: 1387909 - protein, 9 aa, Homo Sapiens
CQVQSQAHG

SEQ ID NO: 1387910 - protein, 9 aa, Homo Sapiens
ALLGKKMTA

SEQ ID NO: 1387911 - protein, 9 aa, Homo Sapiens
RVENVNPYE

SEQ ID NO: 1387912 - protein, 9 aa, Homo Sapiens
LLNNFLKHK

SEQ ID NO: 1387913 - protein, 9 aa, Homo Sapiens
GRLPPGAPF

SEQ ID NO: 1387914 - protein, 9 aa, Homo Sapiens
NSTDMIKML

SEQ ID NO: 1387915 - protein, 9 aa, Homo Sapiens
RLDFYQHNW

SEQ ID NO: 1387916 - protein, 9 aa, Homo Sapiens
ATMSPWYRG

SEQ ID NO: 1387917 - protein, 9 aa, Homo Sapiens
GNTVQLHGM

SEQ ID NO: 1387918 - protein, 9 aa, Homo Sapiens
SWSWQVSLR

SEQ ID NO: 1387919 - protein, 9 aa, Homo Sapiens
FITTIFMAQ

SEQ ID NO: 1387920 - protein, 9 aa, Homo Sapiens
KPISDNSSR

SEQ ID NO: 1387921 - protein, 9 aa, Homo Sapiens
PPSQPPSPS

SEQ ID NO: 1387922 - protein, 9 aa, Homo Sapiens
SAPRAPPIM

SEQ ID NO: 1387923 - protein, 9 aa, Homo Sapiens
FLPKIFRKM

SEQ ID NO: 1387924 - protein, 9 aa, Homo Sapiens
HIIIPLERR

SEQ ID NO: 1387925 - protein, 9 aa, Homo Sapiens
SQPPSPSSL

SEQ ID NO: 1387926 - protein, 9 aa, Homo Sapiens
DGVFQRLWD

SEQ ID NO: 1387927 - protein, 9 aa, Homo Sapiens
ILGKYKEVV

SEQ ID NO: 1387928 - protein, 9 aa, Homo Sapiens
LPPVTSQEA

SEQ ID NO: 1387929 - protein, 9 aa, Homo Sapiens
PTSFDSALH

SEQ ID NO: 1387930 - protein, 9 aa, Homo Sapiens
DRVFGIRWD

SEQ ID NO: 1387931 - protein, 9 aa, Homo Sapiens
DEENRDVNR

SEQ ID NO: 1387932 - protein, 9 aa, Homo Sapiens
LVPQAVDGW

SEQ ID NO: 1387933 - protein, 9 aa, Homo Sapiens
RLMTRSLVL

SEQ ID NO: 1387934 - protein, 9 aa, Homo Sapiens
SIKREIQNS

SEQ ID NO: 1387935 - protein, 9 aa, Homo Sapiens
QRIFITTIF

SEQ ID NO: 1387936 - protein, 9 aa, Homo Sapiens
PQREASTWA

SEQ ID NO: 1387937 - protein, 9 aa, Homo Sapiens
STCLESGMS

SEQ ID NO: 1387938 - protein, 9 aa, Homo Sapiens
FLQLAEPLW

SEQ ID NO: 1387939 - protein, 9 aa, Homo Sapiens
FPREHRIGI

SEQ ID NO: 1387940 - protein, 9 aa, Homo Sapiens
VSSLKKQYI

SEQ ID NO: 1387941 - protein, 9 aa, Homo Sapiens
WCNGKKIGD

SEQ ID NO: 1387942 - protein, 9 aa, Homo Sapiens
QEILLLAVG

SEQ ID NO: 1387943 - protein, 9 aa, Homo Sapiens
ISWIRQVVT

SEQ ID NO: 1387944 - protein, 9 aa, Homo Sapiens
PEALSFTKQ

SEQ ID NO: 1387945 - protein, 9 aa, Homo Sapiens
GLRANTVLE

SEQ ID NO: 1387946 - protein, 9 aa, Homo Sapiens
FGEVCTCQV

SEQ ID NO: 1387947 - protein, 9 aa, Homo Sapiens
EARAPTKQP

SEQ ID NO: 1387948 - protein, 9 aa, Homo Sapiens
KKTIGCWEK

SEQ ID NO: 1387949 - protein, 9 aa, Homo Sapiens
VQGVAAPPL

SEQ ID NO: 1387950 - protein, 9 aa, Homo Sapiens
TAARGIKEP

SEQ ID NO: 1387951 - protein, 9 aa, Homo Sapiens
YDEEDGDEV

SEQ ID NO: 1387952 - protein, 9 aa, Homo Sapiens
MSHYRHLLR

SEQ ID NO: 1387953 - protein, 9 aa, Homo Sapiens
RGAESMTEE

SEQ ID NO: 1387954 - protein, 9 aa, Homo Sapiens
TTNKLTFSF

SEQ ID NO: 1387955 - protein, 9 aa, Homo Sapiens
PRAFKVPLL

SEQ ID NO: 1387956 - protein, 9 aa, Homo Sapiens
PGGCHPAWL

SEQ ID NO: 1387957 - protein, 9 aa, Homo Sapiens
LDGCPVWYN

SEQ ID NO: 1387958 - protein, 9 aa, Homo Sapiens
GREVATQMQ

SEQ ID NO: 1387959 - protein, 9 aa, Homo Sapiens
LRVTDCTGL

SEQ ID NO: 1387960 - protein, 9 aa, Homo Sapiens
GKRPQNPSN

SEQ ID NO: 1387961 - protein, 9 aa, Homo Sapiens
DTSARVSDL

SEQ ID NO: 1387962 - protein, 9 aa, Homo Sapiens
GEDALVTRY

SEQ ID NO: 1387963 - protein, 9 aa, Homo Sapiens
RPEAAQLSE

SEQ ID NO: 1387964 - protein, 9 aa, Homo Sapiens
VIVGSPIWH

SEQ ID NO: 1387965 - protein, 9 aa, Homo Sapiens
VNLGQGHPA

SEQ ID NO: 1387966 - protein, 9 aa, Homo Sapiens
IDETKHSVL

SEQ ID NO: 1387967 - protein, 9 aa, Homo Sapiens
ATCSPSGRW

SEQ ID NO: 1387968 - protein, 9 aa, Homo Sapiens
HHRLCPASS

SEQ ID NO: 1387969 - protein, 9 aa, Homo Sapiens
CPSLYWEWP

SEQ ID NO: 1387970 - protein, 9 aa, Homo Sapiens
FLCLKKGRY

SEQ ID NO: 1387971 - protein, 9 aa, Homo Sapiens
HRLWWPHGA

SEQ ID NO: 1387972 - protein, 9 aa, Homo Sapiens
HVYAMKILH

SEQ ID NO: 1387973 - protein, 9 aa, Homo Sapiens
LLKKSDGIW

SEQ ID NO: 1387974 - protein, 9 aa, Homo Sapiens
LSQTGFSYD

SEQ ID NO: 1387975 - protein, 9 aa, Homo Sapiens
SAQKNECTG

SEQ ID NO: 1387976 - protein, 9 aa, Homo Sapiens
HQPQPMEKS

SEQ ID NO: 1387977 - protein, 9 aa, Homo Sapiens
RELCRQWLH

SEQ ID NO: 1387978 - protein, 9 aa, Homo Sapiens
VKKCHEKST

SEQ ID NO: 1387979 - protein, 9 aa, Homo Sapiens
MPCTTSHLE

SEQ ID NO: 1387980 - protein, 9 aa, Homo Sapiens
WYLGEERYG

SEQ ID NO: 1387981 - protein, 9 aa, Homo Sapiens
QTEGGFWKL

SEQ ID NO: 1387982 - protein, 9 aa, Homo Sapiens
FHSLRRDGP

SEQ ID NO: 1387983 - protein, 9 aa, Homo Sapiens
MRNPTFNEM

SEQ ID NO: 1387984 - protein, 9 aa, Homo Sapiens
EQFPFTSPT

SEQ ID NO: 1387985 - protein, 9 aa, Homo Sapiens
EIDKRMDSI

SEQ ID NO: 1387986 - protein, 9 aa, Homo Sapiens
HRARFLHET

SEQ ID NO: 1387987 - protein, 9 aa, Homo Sapiens
LLTRTTAQL

SEQ ID NO: 1387988 - protein, 9 aa, Homo Sapiens
MDEDFSITE

SEQ ID NO: 1387989 - protein, 9 aa, Homo Sapiens
ILHKADMLE

SEQ ID NO: 1387990 - protein, 9 aa, Homo Sapiens
FIIRSLQHF

SEQ ID NO: 1387991 - protein, 9 aa, Homo Sapiens
LGEERYGGT

SEQ ID NO: 1387992 - protein, 9 aa, Homo Sapiens
SSFSSTSSF

SEQ ID NO: 1387993 - protein, 9 aa, Homo Sapiens
GTHHVVPAQ

SEQ ID NO: 1387994 - protein, 9 aa, Homo Sapiens
DCFVAICNP

SEQ ID NO: 1387995 - protein, 9 aa, Homo Sapiens
HAKEVLKKQ

SEQ ID NO: 1387996 - protein, 9 aa, Homo Sapiens
EVGAAGQER

SEQ ID NO: 1387997 - protein, 9 aa, Homo Sapiens
HLPVTAFII

SEQ ID NO: 1387998 - protein, 9 aa, Homo Sapiens
PQPDPHLCL

SEQ ID NO: 1387999 - protein, 9 aa, Homo Sapiens
KCPLLLVYI

SEQ ID NO: 1388000 - protein, 9 aa, Homo Sapiens
HHYSNARGS

SEQ ID NO: 1388001 - protein, 9 aa, Homo Sapiens
ELLLANIWV

SEQ ID NO: 1388002 - protein, 9 aa, Homo Sapiens
RKPHPGQQD

SEQ ID NO: 1388003 - protein, 9 aa, Homo Sapiens
LWRSTGGWP

SEQ ID NO: 1388004 - protein, 9 aa, Homo Sapiens
QGFHDETAF

SEQ ID NO: 1388005 - protein, 9 aa, Homo Sapiens
PKWKHMQET

SEQ ID NO: 1388006 - protein, 9 aa, Homo Sapiens
SSPTTHRDM

SEQ ID NO: 1388007 - protein, 9 aa, Homo Sapiens
WAPRSTATS

SEQ ID NO: 1388008 - protein, 9 aa, Homo Sapiens
STILILKFL

SEQ ID NO: 1388009 - protein, 9 aa, Homo Sapiens
ALAAGDYDV

SEQ ID NO: 1388010 - protein, 9 aa, Homo Sapiens
MLSEEIIGE

SEQ ID NO: 1388011 - protein, 9 aa, Homo Sapiens
PVQRTACDI

SEQ ID NO: 1388012 - protein, 9 aa, Homo Sapiens
SFSLCGVPA

SEQ ID NO: 1388013 - protein, 9 aa, Homo Sapiens
PERIHQSPY

SEQ ID NO: 1388014 - protein, 9 aa, Homo Sapiens
APPECCSSW

SEQ ID NO: 1388015 - protein, 9 aa, Homo Sapiens
FQRLWDWAP

SEQ ID NO: 1388016 - protein, 9 aa, Homo Sapiens
SSMKSCKVR

SEQ ID NO: 1388017 - protein, 9 aa, Homo Sapiens
YNIIGPLDA

SEQ ID NO: 1388018 - protein, 9 aa, Homo Sapiens
DGWMYDTVQ

SEQ ID NO: 1388019 - protein, 9 aa, Homo Sapiens
IFGRITTGA

SEQ ID NO: 1388020 - protein, 9 aa, Homo Sapiens
TLGLVASLW

SEQ ID NO: 1388021 - protein, 9 aa, Homo Sapiens
YSKHTLSAL

SEQ ID NO: 1388022 - protein, 9 aa, Homo Sapiens
IPTGSEADG

SEQ ID NO: 1388023 - protein, 9 aa, Homo Sapiens
DSLCSHRGL

SEQ ID NO: 1388024 - protein, 9 aa, Homo Sapiens
PAPPTVSQA

SEQ ID NO: 1388025 - protein, 9 aa, Homo Sapiens
FWLSLLYWP

SEQ ID NO: 1388026 - protein, 9 aa, Homo Sapiens
SLRAARAHQ

SEQ ID NO: 1388027 - protein, 9 aa, Homo Sapiens
EDMKELVVA

SEQ ID NO: 1388028 - protein, 9 aa, Homo Sapiens
WINEDGEEL

SEQ ID NO: 1388029 - protein, 9 aa, Homo Sapiens
DQVKKRKKR

SEQ ID NO: 1388030 - protein, 9 aa, Homo Sapiens
STSFLSMWL

SEQ ID NO: 1388031 - protein, 9 aa, Homo Sapiens
KEVVAQYQM

SEQ ID NO: 1388032 - protein, 9 aa, Homo Sapiens
SWSCWSASS

SEQ ID NO: 1388033 - protein, 9 aa, Homo Sapiens
ILWDLLRFL

SEQ ID NO: 1388034 - protein, 9 aa, Homo Sapiens
NKYLRQSNQ

SEQ ID NO: 1388035 - protein, 9 aa, Homo Sapiens
RSGSRIPSA

SEQ ID NO: 1388036 - protein, 9 aa, Homo Sapiens
DGTFILSCV

SEQ ID NO: 1388037 - protein, 9 aa, Homo Sapiens
PWDINAVCA

SEQ ID NO: 1388038 - protein, 9 aa, Homo Sapiens
SPTTHLQAR

SEQ ID NO: 1388039 - protein, 9 aa, Homo Sapiens
GGPGQSAPS

SEQ ID NO: 1388040 - protein, 9 aa, Homo Sapiens
VSQVIIAMY

SEQ ID NO: 1388041 - protein, 9 aa, Homo Sapiens
SAYVRVGKG

SEQ ID NO: 1388042 - protein, 9 aa, Homo Sapiens
QAGPGRSQV

SEQ ID NO: 1388043 - protein, 9 aa, Homo Sapiens
FMSSTSFLS

SEQ ID NO: 1388044 - protein, 9 aa, Homo Sapiens
FVTLASQFL

SEQ ID NO: 1388045 - protein, 9 aa, Homo Sapiens
SGVPTQLVL

SEQ ID NO: 1388046 - protein, 9 aa, Homo Sapiens
VLTASDDGD

SEQ ID NO: 1388047 - protein, 9 aa, Homo Sapiens
YYSTRYIYL

SEQ ID NO: 1388048 - protein, 9 aa, Homo Sapiens
LTIMGYDRY

SEQ ID NO: 1388049 - protein, 9 aa, Homo Sapiens
KEEFRDLLK

SEQ ID NO: 1388050 - protein, 9 aa, Homo Sapiens
NPTLFPRPE

SEQ ID NO: 1388051 - protein, 9 aa, Homo Sapiens
PTAAPPTHA

SEQ ID NO: 1388052 - protein, 9 aa, Homo Sapiens
VDNNHCQMS

SEQ ID NO: 1388053 - protein, 9 aa, Homo Sapiens
ALRKIQENY

SEQ ID NO: 1388054 - protein, 9 aa, Homo Sapiens
VEIGSQQYK

SEQ ID NO: 1388055 - protein, 9 aa, Homo Sapiens
ASAKKNSGP

SEQ ID NO: 1388056 - protein, 9 aa, Homo Sapiens
FRDWHSQRS

SEQ ID NO: 1388057 - protein, 9 aa, Homo Sapiens
EEQQDSGSK

SEQ ID NO: 1388058 - protein, 9 aa, Homo Sapiens
PACCMQKSG

SEQ ID NO: 1388059 - protein, 9 aa, Homo Sapiens
CHWTIVPLT

SEQ ID NO: 1388060 - protein, 9 aa, Homo Sapiens
ITVTRMRQV

SEQ ID NO: 1388061 - protein, 9 aa, Homo Sapiens
PSAPVSGGQ

SEQ ID NO: 1388062 - protein, 9 aa, Homo Sapiens
LKKQLFEKN

SEQ ID NO: 1388063 - protein, 9 aa, Homo Sapiens
HIKWICSMK

SEQ ID NO: 1388064 - protein, 9 aa, Homo Sapiens
AQKEMKYEH

SEQ ID NO: 1388065 - protein, 9 aa, Homo Sapiens
TTLPQEFAA

SEQ ID NO: 1388066 - protein, 9 aa, Homo Sapiens
AVGKARRRN

SEQ ID NO: 1388067 - protein, 9 aa, Homo Sapiens
AGKLPHHMR

SEQ ID NO: 1388068 - protein, 9 aa, Homo Sapiens
VILVAWDPV

SEQ ID NO: 1388069 - protein, 9 aa, Homo Sapiens
RNLKSCIKW

SEQ ID NO: 1388070 - protein, 9 aa, Homo Sapiens
RQDVQSLLA

SEQ ID NO: 1388071 - protein, 9 aa, Homo Sapiens
IETTNVEKR

SEQ ID NO: 1388072 - protein, 9 aa, Homo Sapiens
IEAKKRIMW

SEQ ID NO: 1388073 - protein, 9 aa, Homo Sapiens
LHRFLCFSS

SEQ ID NO: 1388074 - protein, 9 aa, Homo Sapiens
ACAPGRVAE

SEQ ID NO: 1388075 - protein, 9 aa, Homo Sapiens
QKSVPCVPI

SEQ ID NO: 1388076 - protein, 9 aa, Homo Sapiens
AMWPGTDIP

SEQ ID NO: 1388077 - protein, 9 aa, Homo Sapiens
DPYWKEDLP

SEQ ID NO: 1388078 - protein, 9 aa, Homo Sapiens
APIPMMPAS

SEQ ID NO: 1388079 - protein, 9 aa, Homo Sapiens
NVNPKILMT

SEQ ID NO: 1388080 - protein, 9 aa, Homo Sapiens
AHPSRPCRM

SEQ ID NO: 1388081 - protein, 9 aa, Homo Sapiens
LLLVVMSFD

SEQ ID NO: 1388082 - protein, 9 aa, Homo Sapiens
EQKGKRPQN

SEQ ID NO: 1388083 - protein, 9 aa, Homo Sapiens
QEPDGDYQT

SEQ ID NO: 1388084 - protein, 9 aa, Homo Sapiens
MTRSLVLRF

SEQ ID NO: 1388085 - protein, 9 aa, Homo Sapiens
PRTRTCPSP

SEQ ID NO: 1388086 - protein, 9 aa, Homo Sapiens
SRWAPRSTA

SEQ ID NO: 1388087 - protein, 9 aa, Homo Sapiens
DGWLRNPDQ

SEQ ID NO: 1388088 - protein, 9 aa, Homo Sapiens
VYIEELQPA

SEQ ID NO: 1388089 - protein, 9 aa, Homo Sapiens
ATPQKSSMA

SEQ ID NO: 1388090 - protein, 9 aa, Homo Sapiens
PWVLRVTDC

SEQ ID NO: 1388091 - protein, 9 aa, Homo Sapiens
SIREKPQEV

SEQ ID NO: 1388092 - protein, 9 aa, Homo Sapiens
KDSLTCFNQ

SEQ ID NO: 1388093 - protein, 9 aa, Homo Sapiens
AKKGSKPLC

SEQ ID NO: 1388094 - protein, 9 aa, Homo Sapiens
STASGQGKK

SEQ ID NO: 1388095 - protein, 9 aa, Homo Sapiens
HKLFSFQMH

SEQ ID NO: 1388096 - protein, 9 aa, Homo Sapiens
PDVAHLACP

SEQ ID NO: 1388097 - protein, 9 aa, Homo Sapiens
SHLEGTAYG

SEQ ID NO: 1388098 - protein, 9 aa, Homo Sapiens
GVVDNNHCQ

SEQ ID NO: 1388099 - protein, 9 aa, Homo Sapiens
GGLSVAFSP

SEQ ID NO: 1388100 - protein, 9 aa, Homo Sapiens
IRSSPKLFS

SEQ ID NO: 1388101 - protein, 9 aa, Homo Sapiens
DCFVAQLVV

SEQ ID NO: 1388102 - protein, 9 aa, Homo Sapiens
TASDDGDPP

SEQ ID NO: 1388103 - protein, 9 aa, Homo Sapiens
CKAEFEDSG

SEQ ID NO: 1388104 - protein, 9 aa, Homo Sapiens
FHFPLYWFS

SEQ ID NO: 1388105 - protein, 9 aa, Homo Sapiens
VLVATVLMI

SEQ ID NO: 1388106 - protein, 9 aa, Homo Sapiens
AIACDALSS

SEQ ID NO: 1388107 - protein, 9 aa, Homo Sapiens
ELRESIKRE

SEQ ID NO: 1388108 - protein, 9 aa, Homo Sapiens
GGCLPPEPG

SEQ ID NO: 1388109 - protein, 9 aa, Homo Sapiens
SSQSLGRPG

SEQ ID NO: 1388110 - protein, 9 aa, Homo Sapiens
KFLSSSTHL

SEQ ID NO: 1388111 - protein, 9 aa, Homo Sapiens
GSPGMQGAR

SEQ ID NO: 1388112 - protein, 9 aa, Homo Sapiens
NMLPVRSQT

SEQ ID NO: 1388113 - protein, 9 aa, Homo Sapiens
TGGWPTSSC

SEQ ID NO: 1388114 - protein, 9 aa, Homo Sapiens
PMVDPEARA

SEQ ID NO: 1388115 - protein, 9 aa, Homo Sapiens
TSPEEEPIL

SEQ ID NO: 1388116 - protein, 9 aa, Homo Sapiens
EEYLSPQRS

SEQ ID NO: 1388117 - protein, 9 aa, Homo Sapiens
KCKHRKRSR

SEQ ID NO: 1388118 - protein, 9 aa, Homo Sapiens
LKTNWKNMV

SEQ ID NO: 1388119 - protein, 9 aa, Homo Sapiens
KGGVPPQQT

SEQ ID NO: 1388120 - protein, 9 aa, Homo Sapiens
TATKPGLQE

SEQ ID NO: 1388121 - protein, 9 aa, Homo Sapiens
IEAYSSPST

SEQ ID NO: 1388122 - protein, 9 aa, Homo Sapiens
DYDEEDGDE

SEQ ID NO: 1388123 - protein, 9 aa, Homo Sapiens
QVLVMVNGV

SEQ ID NO: 1388124 - protein, 9 aa, Homo Sapiens
SAGCSTTAA

SEQ ID NO: 1388125 - protein, 9 aa, Homo Sapiens
SCSSLKNHK

SEQ ID NO: 1388126 - protein, 9 aa, Homo Sapiens
VFQRLWDWA

SEQ ID NO: 1388127 - protein, 9 aa, Homo Sapiens
PQQTRKTCI

SEQ ID NO: 1388128 - protein, 9 aa, Homo Sapiens
AREDHSRLQ

SEQ ID NO: 1388129 - protein, 9 aa, Homo Sapiens
FILLPCEAP

SEQ ID NO: 1388130 - protein, 9 aa, Homo Sapiens
PRMPGPPWP

SEQ ID NO: 1388131 - protein, 9 aa, Homo Sapiens
VSAPQTETR

SEQ ID NO: 1388132 - protein, 9 aa, Homo Sapiens
LVIFHFPLY

SEQ ID NO: 1388133 - protein, 9 aa, Homo Sapiens
RGASSSTSR

SEQ ID NO: 1388134 - protein, 9 aa, Homo Sapiens
FSSNLIQAV

SEQ ID NO: 1388135 - protein, 9 aa, Homo Sapiens
MNSHVPDCH

SEQ ID NO: 1388136 - protein, 9 aa, Homo Sapiens
GPKAHWKLQ

SEQ ID NO: 1388137 - protein, 9 aa, Homo Sapiens
ENDTTLQEL

SEQ ID NO: 1388138 - protein, 9 aa, Homo Sapiens
CWEKLFSMF

SEQ ID NO: 1388139 - protein, 9 aa, Homo Sapiens
SCFFSVELM

SEQ ID NO: 1388140 - protein, 9 aa, Homo Sapiens
SSTGSSREV

SEQ ID NO: 1388141 - protein, 9 aa, Homo Sapiens
NCSITSIRE

SEQ ID NO: 1388142 - protein, 9 aa, Homo Sapiens
RKMRNPTFN

SEQ ID NO: 1388143 - protein, 9 aa, Homo Sapiens
CRQWLHPEV

SEQ ID NO: 1388144 - protein, 9 aa, Homo Sapiens
IKRPVNAFM

SEQ ID NO: 1388145 - protein, 9 aa, Homo Sapiens
WGWGAWLAV

SEQ ID NO: 1388146 - protein, 9 aa, Homo Sapiens
NVRSKNFCL

SEQ ID NO: 1388147 - protein, 9 aa, Homo Sapiens
VAMRCAIWL

SEQ ID NO: 1388148 - protein, 9 aa, Homo Sapiens
GCWEKLFSM

SEQ ID NO: 1388149 - protein, 9 aa, Homo Sapiens
QSFGPVMVY

SEQ ID NO: 1388150 - protein, 9 aa, Homo Sapiens
KKKKDKKRR

SEQ ID NO: 1388151 - protein, 9 aa, Homo Sapiens
SCLCPLASQ

SEQ ID NO: 1388152 - protein, 9 aa, Homo Sapiens
PNTFKYPRE

SEQ ID NO: 1388153 - protein, 9 aa, Homo Sapiens
QSQQQPPQP

SEQ ID NO: 1388154 - protein, 9 aa, Homo Sapiens
VVRPRSLRP

SEQ ID NO: 1388155 - protein, 9 aa, Homo Sapiens
ATRKHIIIP

SEQ ID NO: 1388156 - protein, 9 aa, Homo Sapiens
HFGPDAVAV

SEQ ID NO: 1388157 - protein, 9 aa, Homo Sapiens
NNHSKEVAV

SEQ ID NO: 1388158 - protein, 9 aa, Homo Sapiens
DRCAGIVRR

SEQ ID NO: 1388159 - protein, 9 aa, Homo Sapiens
LWGWSLWLS

SEQ ID NO: 1388160 - protein, 9 aa, Homo Sapiens
VAMAFDCFV

SEQ ID NO: 1388161 - protein, 9 aa, Homo Sapiens
AISMMYITS

SEQ ID NO: 1388162 - protein, 9 aa, Homo Sapiens
RLPLKWKEL

SEQ ID NO: 1388163 - protein, 9 aa, Homo Sapiens
TVDTATKPG

SEQ ID NO: 1388164 - protein, 9 aa, Homo Sapiens
GCNWTPESP

SEQ ID NO: 1388165 - protein, 9 aa, Homo Sapiens
TSPAPWTQR

SEQ ID NO: 1388166 - protein, 9 aa, Homo Sapiens
FMAQKEMKY

SEQ ID NO: 1388167 - protein, 9 aa, Homo Sapiens
KKRGASSST

SEQ ID NO: 1388168 - protein, 9 aa, Homo Sapiens
EDWIEDMLS

SEQ ID NO: 1388169 - protein, 9 aa, Homo Sapiens
NPHFQNKVL

SEQ ID NO: 1388170 - protein, 9 aa, Homo Sapiens
EVQIGGNPG

SEQ ID NO: 1388171 - protein, 9 aa, Homo Sapiens
NSDSSSPNV

SEQ ID NO: 1388172 - protein, 9 aa, Homo Sapiens
RQTEKCVLE

SEQ ID NO: 1388173 - protein, 9 aa, Homo Sapiens
RPVNAFMVW

SEQ ID NO: 1388174 - protein, 9 aa, Homo Sapiens
VVMSFDRYV

SEQ ID NO: 1388175 - protein, 9 aa, Homo Sapiens
LKKEQKKGK

SEQ ID NO: 1388176 - protein, 9 aa, Homo Sapiens
ERVSRGKAP

SEQ ID NO: 1388177 - protein, 9 aa, Homo Sapiens
GDRCAGIVR

SEQ ID NO: 1388178 - protein, 9 aa, Homo Sapiens
MPQSFFFFF

SEQ ID NO: 1388179 - protein, 9 aa, Homo Sapiens
KKREKIINP

SEQ ID NO: 1388180 - protein, 9 aa, Homo Sapiens
SDDESFNPS

SEQ ID NO: 1388181 - protein, 9 aa, Homo Sapiens
LPTKMVEKA

SEQ ID NO: 1388182 - protein, 9 aa, Homo Sapiens
LSQVGVKIV

SEQ ID NO: 1388183 - protein, 9 aa, Homo Sapiens
NQPLRNFIG

SEQ ID NO: 1388184 - protein, 9 aa, Homo Sapiens
THLQARLAL

SEQ ID NO: 1388185 - protein, 9 aa, Homo Sapiens
VSNNIVVHP

SEQ ID NO: 1388186 - protein, 9 aa, Homo Sapiens
YKGKSPQPP

SEQ ID NO: 1388187 - protein, 9 aa, Homo Sapiens
NTTLPQEFA

SEQ ID NO: 1388188 - protein, 9 aa, Homo Sapiens
TKGRPRKIA

SEQ ID NO: 1388189 - protein, 9 aa, Homo Sapiens
FTHFYLDQW

SEQ ID NO: 1388190 - protein, 9 aa, Homo Sapiens
QHFWTSAGE

SEQ ID NO: 1388191 - protein, 9 aa, Homo Sapiens
EHYVLYMSN

SEQ ID NO: 1388192 - protein, 9 aa, Homo Sapiens
LKRRNNMMN

SEQ ID NO: 1388193 - protein, 9 aa, Homo Sapiens
STSRDSRSF

SEQ ID NO: 1388194 - protein, 9 aa, Homo Sapiens
PDPERVFTL

SEQ ID NO: 1388195 - protein, 9 aa, Homo Sapiens
IRGKLGVSP

SEQ ID NO: 1388196 - protein, 9 aa, Homo Sapiens
FTKQNKLVL

SEQ ID NO: 1388197 - protein, 9 aa, Homo Sapiens
EVCTCQVRA

SEQ ID NO: 1388198 - protein, 9 aa, Homo Sapiens
KSVPCVPIL

SEQ ID NO: 1388199 - protein, 9 aa, Homo Sapiens
KNLCPAVKE

SEQ ID NO: 1388200 - protein, 9 aa, Homo Sapiens
CYVRLSAVG

SEQ ID NO: 1388201 - protein, 9 aa, Homo Sapiens
RLRGPGPLE

SEQ ID NO: 1388202 - protein, 9 aa, Homo Sapiens
AFDVTPTTS

SEQ ID NO: 1388203 - protein, 9 aa, Homo Sapiens
SPRALLTQP

SEQ ID NO: 1388204 - protein, 9 aa, Homo Sapiens
FRTSMKSSS

SEQ ID NO: 1388205 - protein, 9 aa, Homo Sapiens
NLKSVDFEA

SEQ ID NO: 1388206 - protein, 9 aa, Homo Sapiens
QTEKCVLET

SEQ ID NO: 1388207 - protein, 9 aa, Homo Sapiens
PPRLPLKWK

SEQ ID NO: 1388208 - protein, 9 aa, Homo Sapiens
VSITSIFLI

SEQ ID NO: 1388209 - protein, 9 aa, Homo Sapiens
RVECLEEFE

SEQ ID NO: 1388210 - protein, 9 aa, Homo Sapiens
PMGARAPAP

SEQ ID NO: 1388211 - protein, 9 aa, Homo Sapiens
WTLDLVLSL

SEQ ID NO: 1388212 - protein, 9 aa, Homo Sapiens
CGCSPSMST

SEQ ID NO: 1388213 - protein, 9 aa, Homo Sapiens
CQDQWFSTP

SEQ ID NO: 1388214 - protein, 9 aa, Homo Sapiens
PWALMSPRA

SEQ ID NO: 1388215 - protein, 9 aa, Homo Sapiens
QQKSISLYW

SEQ ID NO: 1388216 - protein, 9 aa, Homo Sapiens
HQASPTKIE

SEQ ID NO: 1388217 - protein, 9 aa, Homo Sapiens
CGSCKVFKR

SEQ ID NO: 1388218 - protein, 9 aa, Homo Sapiens
HQATRKHII

SEQ ID NO: 1388219 - protein, 9 aa, Homo Sapiens
WLNRSKVES

SEQ ID NO: 1388220 - protein, 9 aa, Homo Sapiens
LRQSISFSD

SEQ ID NO: 1388221 - protein, 9 aa, Homo Sapiens
LLIEVSEEL

SEQ ID NO: 1388222 - protein, 9 aa, Homo Sapiens
FEGQYKHMH

SEQ ID NO: 1388223 - protein, 9 aa, Homo Sapiens
LTLTKMILT

SEQ ID NO: 1388224 - protein, 9 aa, Homo Sapiens
EAELCQVQS

SEQ ID NO: 1388225 - protein, 9 aa, Homo Sapiens
PDVPDMATS

SEQ ID NO: 1388226 - protein, 9 aa, Homo Sapiens
VVLGILIFR

SEQ ID NO: 1388227 - protein, 9 aa, Homo Sapiens
MMNKMRDNK

SEQ ID NO: 1388228 - protein, 9 aa, Homo Sapiens
GDEQVAMRC

SEQ ID NO: 1388229 - protein, 9 aa, Homo Sapiens
KFYIPHVHV

SEQ ID NO: 1388230 - protein, 9 aa, Homo Sapiens
ETRAPTPRS

SEQ ID NO: 1388231 - protein, 9 aa, Homo Sapiens
EAAEARAKL

SEQ ID NO: 1388232 - protein, 9 aa, Homo Sapiens
RYIYLLVRH

SEQ ID NO: 1388233 - protein, 9 aa, Homo Sapiens
RRRSQRRRR

SEQ ID NO: 1388234 - protein, 9 aa, Homo Sapiens
RQSFNKFIQ

SEQ ID NO: 1388235 - protein, 9 aa, Homo Sapiens
RHPSWPWTR

SEQ ID NO: 1388236 - protein, 9 aa, Homo Sapiens
LNNKYLRQS

SEQ ID NO: 1388237 - protein, 9 aa, Homo Sapiens
RQSISFSDL

SEQ ID NO: 1388238 - protein, 9 aa, Homo Sapiens
TSSSAVSSL

SEQ ID NO: 1388239 - protein, 9 aa, Homo Sapiens
NEPALVRFL

SEQ ID NO: 1388240 - protein, 9 aa, Homo Sapiens
DRRGAESMT

SEQ ID NO: 1388241 - protein, 9 aa, Homo Sapiens
PPASPWLPI

SEQ ID NO: 1388242 - protein, 9 aa, Homo Sapiens
ISTLVLDVS

SEQ ID NO: 1388243 - protein, 9 aa, Homo Sapiens
CNVFLGGVP

SEQ ID NO: 1388244 - protein, 9 aa, Homo Sapiens
HSSSQCTQG

SEQ ID NO: 1388245 - protein, 9 aa, Homo Sapiens
KLSSPTTHR

SEQ ID NO: 1388246 - protein, 9 aa, Homo Sapiens
SCKVFKRAM

SEQ ID NO: 1388247 - protein, 9 aa, Homo Sapiens
LDMYECLRV

SEQ ID NO: 1388248 - protein, 9 aa, Homo Sapiens
FDVTPTTSS

SEQ ID NO: 1388249 - protein, 9 aa, Homo Sapiens
LIKQRKKVL

SEQ ID NO: 1388250 - protein, 9 aa, Homo Sapiens
RLDHQATYT

SEQ ID NO: 1388251 - protein, 9 aa, Homo Sapiens
SFSSNLIQA

SEQ ID NO: 1388252 - protein, 9 aa, Homo Sapiens
TAGVNIAVI

SEQ ID NO: 1388253 - protein, 9 aa, Homo Sapiens
SAGQNATVA

SEQ ID NO: 1388254 - protein, 9 aa, Homo Sapiens
TGLTGEQTH

SEQ ID NO: 1388255 - protein, 9 aa, Homo Sapiens
TKIDAASPL

SEQ ID NO: 1388256 - protein, 9 aa, Homo Sapiens
MSQPASSSN

SEQ ID NO: 1388257 - protein, 9 aa, Homo Sapiens
VCQDIPASH

SEQ ID NO: 1388258 - protein, 9 aa, Homo Sapiens
YFAVDPGKD

SEQ ID NO: 1388259 - protein, 9 aa, Homo Sapiens
EVGIDDVFN

SEQ ID NO: 1388260 - protein, 9 aa, Homo Sapiens
QLISGVEIH

SEQ ID NO: 1388261 - protein, 9 aa, Homo Sapiens
MCWRPPSPW

SEQ ID NO: 1388262 - protein, 9 aa, Homo Sapiens
LCCGSSWYI

SEQ ID NO: 1388263 - protein, 9 aa, Homo Sapiens
PATLLVTAK

SEQ ID NO: 1388264 - protein, 9 aa, Homo Sapiens
AAFFTFSLI

SEQ ID NO: 1388265 - protein, 9 aa, Homo Sapiens
PAAYSDLFC

SEQ ID NO: 1388266 - protein, 9 aa, Homo Sapiens
CCQQKEKGP

SEQ ID NO: 1388267 - protein, 9 aa, Homo Sapiens
VDTATKPGL

SEQ ID NO: 1388268 - protein, 9 aa, Homo Sapiens
GSGDLGNGD

SEQ ID NO: 1388269 - protein, 9 aa, Homo Sapiens
PSPVECRNL

SEQ ID NO: 1388270 - protein, 9 aa, Homo Sapiens
PTPVRKHNS

SEQ ID NO: 1388271 - protein, 9 aa, Homo Sapiens
NEKVVLVTG

SEQ ID NO: 1388272 - protein, 9 aa, Homo Sapiens
VVTGAYSKH

SEQ ID NO: 1388273 - protein, 9 aa, Homo Sapiens
TSVVLVCVP

SEQ ID NO: 1388274 - protein, 9 aa, Homo Sapiens
RSSRSNAYF

SEQ ID NO: 1388275 - protein, 9 aa, Homo Sapiens
LPQAQLQGF

SEQ ID NO: 1388276 - protein, 9 aa, Homo Sapiens
TAFFTNKRS

SEQ ID NO: 1388277 - protein, 9 aa, Homo Sapiens
RTCPSPPWS

SEQ ID NO: 1388278 - protein, 9 aa, Homo Sapiens
FSRTASGCA

SEQ ID NO: 1388279 - protein, 9 aa, Homo Sapiens
YKQEVAQLR

SEQ ID NO: 1388280 - protein, 9 aa, Homo Sapiens
DVGLLEGSA

SEQ ID NO: 1388281 - protein, 9 aa, Homo Sapiens
RYQSKASDH

SEQ ID NO: 1388282 - protein, 9 aa, Homo Sapiens
DVPDMATSQ

SEQ ID NO: 1388283 - protein, 9 aa, Homo Sapiens
ICKAGGIPL

SEQ ID NO: 1388284 - protein, 9 aa, Homo Sapiens
SLPLRSSGQ

SEQ ID NO: 1388285 - protein, 9 aa, Homo Sapiens
RESMTLLFE

SEQ ID NO: 1388286 - protein, 9 aa, Homo Sapiens
PGLEDRGLT

SEQ ID NO: 1388287 - protein, 9 aa, Homo Sapiens
LCAVELKSE

SEQ ID NO: 1388288 - protein, 9 aa, Homo Sapiens
SERKGLPFH

SEQ ID NO: 1388289 - protein, 9 aa, Homo Sapiens
SKLKKNISS

SEQ ID NO: 1388290 - protein, 9 aa, Homo Sapiens
LKHLQPEFK

SEQ ID NO: 1388291 - protein, 9 aa, Homo Sapiens
TTPGLEHQH

SEQ ID NO: 1388292 - protein, 9 aa, Homo Sapiens
PEPGDPDAV

SEQ ID NO: 1388293 - protein, 9 aa, Homo Sapiens
TSRDSRSFF

SEQ ID NO: 1388294 - protein, 9 aa, Homo Sapiens
SMKMVLVLV

SEQ ID NO: 1388295 - protein, 9 aa, Homo Sapiens
SKTLDSVAK

SEQ ID NO: 1388296 - protein, 9 aa, Homo Sapiens
HERKYAPRL

SEQ ID NO: 1388297 - protein, 9 aa, Homo Sapiens
HRHPQTAMC

SEQ ID NO: 1388298 - protein, 9 aa, Homo Sapiens
EAFAQGMRR

SEQ ID NO: 1388299 - protein, 9 aa, Homo Sapiens
RIQRCIADS

SEQ ID NO: 1388300 - protein, 9 aa, Homo Sapiens
PPCWWTMGL

SEQ ID NO: 1388301 - protein, 9 aa, Homo Sapiens
GHTSDAGTY

SEQ ID NO: 1388302 - protein, 9 aa, Homo Sapiens
DFIIRDTIP

SEQ ID NO: 1388303 - protein, 9 aa, Homo Sapiens
TSAHPSRPC

SEQ ID NO: 1388304 - protein, 9 aa, Homo Sapiens
SLQQWKRPM

SEQ ID NO: 1388305 - protein, 9 aa, Homo Sapiens
DAQPKKKAT

SEQ ID NO: 1388306 - protein, 9 aa, Homo Sapiens
KYVNFITNP

SEQ ID NO: 1388307 - protein, 9 aa, Homo Sapiens
PSPSSLLSP

SEQ ID NO: 1388308 - protein, 9 aa, Homo Sapiens
ECKQCVKAL

SEQ ID NO: 1388309 - protein, 9 aa, Homo Sapiens
QACQDQWFS

SEQ ID NO: 1388310 - protein, 9 aa, Homo Sapiens
VAQLVVRLG

SEQ ID NO: 1388311 - protein, 9 aa, Homo Sapiens
INIDFRTQE

SEQ ID NO: 1388312 - protein, 9 aa, Homo Sapiens
HKRMHSSER

SEQ ID NO: 1388313 - protein, 9 aa, Homo Sapiens
LKDSRPLCH

SEQ ID NO: 1388314 - protein, 9 aa, Homo Sapiens
NSFEGQYKH

SEQ ID NO: 1388315 - protein, 9 aa, Homo Sapiens
FIPQEAVCV

SEQ ID NO: 1388316 - protein, 9 aa, Homo Sapiens
DGDPPRSST

SEQ ID NO: 1388317 - protein, 9 aa, Homo Sapiens
WDTAGQKYH

SEQ ID NO: 1388318 - protein, 9 aa, Homo Sapiens
LLQTTQVNA

SEQ ID NO: 1388319 - protein, 9 aa, Homo Sapiens
QKLHELVLT

SEQ ID NO: 1388320 - protein, 9 aa, Homo Sapiens
HSNRRFSSC

SEQ ID NO: 1388321 - protein, 9 aa, Homo Sapiens
HEHSNPNYD

SEQ ID NO: 1388322 - protein, 9 aa, Homo Sapiens
ATGQQDGAA

SEQ ID NO: 1388323 - protein, 9 aa, Homo Sapiens
IEELQPALT

SEQ ID NO: 1388324 - protein, 9 aa, Homo Sapiens
RTASGCAFV

SEQ ID NO: 1388325 - protein, 9 aa, Homo Sapiens
IGSGGSPWA

SEQ ID NO: 1388326 - protein, 9 aa, Homo Sapiens
SIMCPLNPA

SEQ ID NO: 1388327 - protein, 9 aa, Homo Sapiens
QGKKKPYEC

SEQ ID NO: 1388328 - protein, 9 aa, Homo Sapiens
PYPFHVLAL

SEQ ID NO: 1388329 - protein, 9 aa, Homo Sapiens
QANGFMKKS

SEQ ID NO: 1388330 - protein, 9 aa, Homo Sapiens
TTQPDDNKP

SEQ ID NO: 1388331 - protein, 9 aa, Homo Sapiens
IRRHPGGDR

SEQ ID NO: 1388332 - protein, 9 aa, Homo Sapiens
PSSQSLTPA

SEQ ID NO: 1388333 - protein, 9 aa, Homo Sapiens
VPYWNSKLT

SEQ ID NO: 1388334 - protein, 9 aa, Homo Sapiens
SVVITRGMK

SEQ ID NO: 1388335 - protein, 9 aa, Homo Sapiens
FRRFSSPRI

SEQ ID NO: 1388336 - protein, 9 aa, Homo Sapiens
LPPAMKHYL

SEQ ID NO: 1388337 - protein, 9 aa, Homo Sapiens
ILVVCRENI

SEQ ID NO: 1388338 - protein, 9 aa, Homo Sapiens
LLEALAVHR

SEQ ID NO: 1388339 - protein, 9 aa, Homo Sapiens
QHFTTGRLM

SEQ ID NO: 1388340 - protein, 9 aa, Homo Sapiens
NLGIPKPLG

SEQ ID NO: 1388341 - protein, 9 aa, Homo Sapiens
SDEEYLSPQ

SEQ ID NO: 1388342 - protein, 9 aa, Homo Sapiens
QLKITVSDV

SEQ ID NO: 1388343 - protein, 9 aa, Homo Sapiens
VYPHFLLQT

SEQ ID NO: 1388344 - protein, 9 aa, Homo Sapiens
ATRRYGELT

SEQ ID NO: 1388345 - protein, 9 aa, Homo Sapiens
WKVWQRRKC

SEQ ID NO: 1388346 - protein, 9 aa, Homo Sapiens
NLGQGHPAS

SEQ ID NO: 1388347 - protein, 9 aa, Homo Sapiens
WSPTPGCIR

SEQ ID NO: 1388348 - protein, 9 aa, Homo Sapiens
KALSKENRR

SEQ ID NO: 1388349 - protein, 9 aa, Homo Sapiens
RGPTPSPLT

SEQ ID NO: 1388350 - protein, 9 aa, Homo Sapiens
CVEIGSQQY

SEQ ID NO: 1388351 - protein, 9 aa, Homo Sapiens
LQAALDDYS

SEQ ID NO: 1388352 - protein, 9 aa, Homo Sapiens
RLWRPTAIR

SEQ ID NO: 1388353 - protein, 9 aa, Homo Sapiens
SQEEDFHLQ

SEQ ID NO: 1388354 - protein, 9 aa, Homo Sapiens
SKNFCLKIY

SEQ ID NO: 1388355 - protein, 9 aa, Homo Sapiens
MMLQNAQVH

SEQ ID NO: 1388356 - protein, 9 aa, Homo Sapiens
SEKMSRISG

SEQ ID NO: 1388357 - protein, 9 aa, Homo Sapiens
WSCWSASSP

SEQ ID NO: 1388358 - protein, 9 aa, Homo Sapiens
PADQKTAIP

SEQ ID NO: 1388359 - protein, 9 aa, Homo Sapiens
TLERLTNSL

SEQ ID NO: 1388360 - protein, 9 aa, Homo Sapiens
TDVECSRYH

SEQ ID NO: 1388361 - protein, 9 aa, Homo Sapiens
AAKRKWKLT

SEQ ID NO: 1388362 - protein, 9 aa, Homo Sapiens
SISHSRRRR

SEQ ID NO: 1388363 - protein, 9 aa, Homo Sapiens
GGSNRGDAA

SEQ ID NO: 1388364 - protein, 9 aa, Homo Sapiens
SRADGLLCS

SEQ ID NO: 1388365 - protein, 9 aa, Homo Sapiens
HEKDQDKEK

SEQ ID NO: 1388366 - protein, 9 aa, Homo Sapiens
PERVSRGKA

SEQ ID NO: 1388367 - protein, 9 aa, Homo Sapiens
SSCCSWSCW

SEQ ID NO: 1388368 - protein, 9 aa, Homo Sapiens
AKKMVTSKL

SEQ ID NO: 1388369 - protein, 9 aa, Homo Sapiens
LCRLYMQFQ

SEQ ID NO: 1388370 - protein, 9 aa, Homo Sapiens
LLRLLIPEC

SEQ ID NO: 1388371 - protein, 9 aa, Homo Sapiens
RAPTPPSTQ

SEQ ID NO: 1388372 - protein, 9 aa, Homo Sapiens
RARGPPSRG

SEQ ID NO: 1388373 - protein, 9 aa, Homo Sapiens
ACQDQWFST

SEQ ID NO: 1388374 - protein, 9 aa, Homo Sapiens
NIPGIRGAL

SEQ ID NO: 1388375 - protein, 9 aa, Homo Sapiens
EPWRAGFQW

SEQ ID NO: 1388376 - protein, 9 aa, Homo Sapiens
SQDVGIWYL

SEQ ID NO: 1388377 - protein, 9 aa, Homo Sapiens
SNRHVCRHF

SEQ ID NO: 1388378 - protein, 9 aa, Homo Sapiens
SSHTNSSVS

SEQ ID NO: 1388379 - protein, 9 aa, Homo Sapiens
IFPAVAFRL

SEQ ID NO: 1388380 - protein, 9 aa, Homo Sapiens
HSPADDPLA

SEQ ID NO: 1388381 - protein, 9 aa, Homo Sapiens
KEQKKGKRK

SEQ ID NO: 1388382 - protein, 9 aa, Homo Sapiens
HMSHGEELR

SEQ ID NO: 1388383 - protein, 9 aa, Homo Sapiens
PVRSQTNAL

SEQ ID NO: 1388384 - protein, 9 aa, Homo Sapiens
KTKISRKMR

SEQ ID NO: 1388385 - protein, 9 aa, Homo Sapiens
GFNSKSGKW

SEQ ID NO: 1388386 - protein, 9 aa, Homo Sapiens
RMHSSERPY

SEQ ID NO: 1388387 - protein, 9 aa, Homo Sapiens
YADDVENSA

SEQ ID NO: 1388388 - protein, 9 aa, Homo Sapiens
CKAGGIPLL

SEQ ID NO: 1388389 - protein, 9 aa, Homo Sapiens
EERCKKRDR

SEQ ID NO: 1388390 - protein, 9 aa, Homo Sapiens
PAAACAPGR

SEQ ID NO: 1388391 - protein, 9 aa, Homo Sapiens
VRMVADEYL

SEQ ID NO: 1388392 - protein, 9 aa, Homo Sapiens
LILEKIEHD

SEQ ID NO: 1388393 - protein, 9 aa, Homo Sapiens
TSGKGFVAS

SEQ ID NO: 1388394 - protein, 9 aa, Homo Sapiens
HKALSKENR

SEQ ID NO: 1388395 - protein, 9 aa, Homo Sapiens
NSTQGMLMA

SEQ ID NO: 1388396 - protein, 9 aa, Homo Sapiens
ILMTGKDLG

SEQ ID NO: 1388397 - protein, 9 aa, Homo Sapiens
SSTRPAAAR

SEQ ID NO: 1388398 - protein, 9 aa, Homo Sapiens
AVAAPSSDP

SEQ ID NO: 1388399 - protein, 9 aa, Homo Sapiens
CQFHYSMDL

SEQ ID NO: 1388400 - protein, 9 aa, Homo Sapiens
SCALSYGRR

SEQ ID NO: 1388401 - protein, 9 aa, Homo Sapiens
CCYVRLSAV

SEQ ID NO: 1388402 - protein, 9 aa, Homo Sapiens
LLLAACTNQ

SEQ ID NO: 1388403 - protein, 9 aa, Homo Sapiens
SSKSFISSQ

SEQ ID NO: 1388404 - protein, 9 aa, Homo Sapiens
HLVHHKRMH

SEQ ID NO: 1388405 - protein, 9 aa, Homo Sapiens
ASGCAFVVS

SEQ ID NO: 1388406 - protein, 9 aa, Homo Sapiens
EWQLLRLKQ

SEQ ID NO: 1388407 - protein, 9 aa, Homo Sapiens
LERRQELPG

SEQ ID NO: 1388408 - protein, 9 aa, Homo Sapiens
QWLHPEVRS

SEQ ID NO: 1388409 - protein, 9 aa, Homo Sapiens
THLPPSSYF

SEQ ID NO: 1388410 - protein, 9 aa, Homo Sapiens
PLERRSPQA

SEQ ID NO: 1388411 - protein, 9 aa, Homo Sapiens
VGRLGGVLP

SEQ ID NO: 1388412 - protein, 9 aa, Homo Sapiens
NSSRADGLL

SEQ ID NO: 1388413 - protein, 9 aa, Homo Sapiens
AMTKKRVNT

SEQ ID NO: 1388414 - protein, 9 aa, Homo Sapiens
CFKKRPQRK

SEQ ID NO: 1388415 - protein, 9 aa, Homo Sapiens
EDYFHIYTD

SEQ ID NO: 1388416 - protein, 9 aa, Homo Sapiens
VRKPLEAML

SEQ ID NO: 1388417 - protein, 9 aa, Homo Sapiens
FKHHRARFL

SEQ ID NO: 1388418 - protein, 9 aa, Homo Sapiens
PEKILSDLL

SEQ ID NO: 1388419 - protein, 9 aa, Homo Sapiens
NMDGWLRNP

SEQ ID NO: 1388420 - protein, 9 aa, Homo Sapiens
INEDGEELA

SEQ ID NO: 1388421 - protein, 9 aa, Homo Sapiens
GQNSTDMIK

SEQ ID NO: 1388422 - protein, 9 aa, Homo Sapiens
STPVDRSTP

SEQ ID NO: 1388423 - protein, 9 aa, Homo Sapiens
GSPKRQKRQ

SEQ ID NO: 1388424 - protein, 9 aa, Homo Sapiens
ILEHYVLYM

SEQ ID NO: 1388425 - protein, 9 aa, Homo Sapiens
PMRSLGEPW

SEQ ID NO: 1388426 - protein, 9 aa, Homo Sapiens
IIFFSPGIG

SEQ ID NO: 1388427 - protein, 9 aa, Homo Sapiens
YVYDLVKTF

SEQ ID NO: 1388428 - protein, 9 aa, Homo Sapiens
REIDKRMDS

SEQ ID NO: 1388429 - protein, 9 aa, Homo Sapiens
MKELVVAKA

SEQ ID NO: 1388430 - protein, 9 aa, Homo Sapiens
GGRGTTDRH

SEQ ID NO: 1388431 - protein, 9 aa, Homo Sapiens
LKVGTASRD

SEQ ID NO: 1388432 - protein, 9 aa, Homo Sapiens
RPWWMPSLA

SEQ ID NO: 1388433 - protein, 9 aa, Homo Sapiens
PKHVNLCAC

SEQ ID NO: 1388434 - protein, 9 aa, Homo Sapiens
MSFLLNNFL

SEQ ID NO: 1388435 - protein, 9 aa, Homo Sapiens
AKKPGGAAR

SEQ ID NO: 1388436 - protein, 9 aa, Homo Sapiens
TSKGDEKGN

SEQ ID NO: 1388437 - protein, 9 aa, Homo Sapiens
LVLNVEMVQ

SEQ ID NO: 1388438 - protein, 9 aa, Homo Sapiens
DHLAKPFSQ

SEQ ID NO: 1388439 - protein, 9 aa, Homo Sapiens
ISLYWGNCR

SEQ ID NO: 1388440 - protein, 9 aa, Homo Sapiens
SPKAQPTLP

SEQ ID NO: 1388441 - protein, 9 aa, Homo Sapiens
TCGLGSSCC

SEQ ID NO: 1388442 - protein, 9 aa, Homo Sapiens
CILYCAPSN

SEQ ID NO: 1388443 - protein, 9 aa, Homo Sapiens
VFLCCGKVS

SEQ ID NO: 1388444 - protein, 9 aa, Homo Sapiens
NGFMKKSHI

SEQ ID NO: 1388445 - protein, 9 aa, Homo Sapiens
RHVLSCMGG

SEQ ID NO: 1388446 - protein, 9 aa, Homo Sapiens
QVAMRCAIW

SEQ ID NO: 1388447 - protein, 9 aa, Homo Sapiens
SGKGFVASP

SEQ ID NO: 1388448 - protein, 9 aa, Homo Sapiens
PRVTRILPC

SEQ ID NO: 1388449 - protein, 9 aa, Homo Sapiens
KEQKGKRPQ

SEQ ID NO: 1388450 - protein, 9 aa, Homo Sapiens
AIKGLLGLP

SEQ ID NO: 1388451 - protein, 9 aa, Homo Sapiens
CGFPGGGGG

SEQ ID NO: 1388452 - protein, 9 aa, Homo Sapiens
APSSMTLTV

SEQ ID NO: 1388453 - protein, 9 aa, Homo Sapiens
PGQSAPSAP

SEQ ID NO: 1388454 - protein, 9 aa, Homo Sapiens
IHTHTFYVS

SEQ ID NO: 1388455 - protein, 9 aa, Homo Sapiens
VGIDDVFNF

SEQ ID NO: 1388456 - protein, 9 aa, Homo Sapiens
YLGLETQKH

SEQ ID NO: 1388457 - protein, 9 aa, Homo Sapiens
QRVHHTDHP

SEQ ID NO: 1388458 - protein, 9 aa, Homo Sapiens
DAVTVLLTR

SEQ ID NO: 1388459 - protein, 9 aa, Homo Sapiens
HRDNLVVVE

SEQ ID NO: 1388460 - protein, 9 aa, Homo Sapiens
LYYSTIMSQ

SEQ ID NO: 1388461 - protein, 9 aa, Homo Sapiens
PARAAALQS

SEQ ID NO: 1388462 - protein, 9 aa, Homo Sapiens
GVWYMPPMT

SEQ ID NO: 1388463 - protein, 9 aa, Homo Sapiens
AGVHGTSHQ

SEQ ID NO: 1388464 - protein, 9 aa, Homo Sapiens
VINVQDYEV

SEQ ID NO: 1388465 - protein, 9 aa, Homo Sapiens
LETYVKLDR

SEQ ID NO: 1388466 - protein, 9 aa, Homo Sapiens
LERRSPQAH

SEQ ID NO: 1388467 - protein, 9 aa, Homo Sapiens
GSQQQLYRP

SEQ ID NO: 1388468 - protein, 9 aa, Homo Sapiens
PTSGPATMS

SEQ ID NO: 1388469 - protein, 9 aa, Homo Sapiens
SVLDMLHHF

SEQ ID NO: 1388470 - protein, 9 aa, Homo Sapiens
WTPTKYLNC

SEQ ID NO: 1388471 - protein, 9 aa, Homo Sapiens
HVPYWNSKL

SEQ ID NO: 1388472 - protein, 9 aa, Homo Sapiens
LKKALAAGD

SEQ ID NO: 1388473 - protein, 9 aa, Homo Sapiens
PVPRKKEED

SEQ ID NO: 1388474 - protein, 9 aa, Homo Sapiens
LLRLQSLLS

SEQ ID NO: 1388475 - protein, 9 aa, Homo Sapiens
SRPPVTANI

SEQ ID NO: 1388476 - protein, 9 aa, Homo Sapiens
DRSKRGEKG

SEQ ID NO: 1388477 - protein, 9 aa, Homo Sapiens
AGSSLCSTS

SEQ ID NO: 1388478 - protein, 9 aa, Homo Sapiens
LVGRLMNRS

SEQ ID NO: 1388479 - protein, 9 aa, Homo Sapiens
LLGKKMTAS

SEQ ID NO: 1388480 - protein, 9 aa, Homo Sapiens
AVPAAACPP

SEQ ID NO: 1388481 - protein, 9 aa, Homo Sapiens
AQEREYIHQ

SEQ ID NO: 1388482 - protein, 9 aa, Homo Sapiens
TSEKFTWAT

SEQ ID NO: 1388483 - protein, 9 aa, Homo Sapiens
WLRPTSGPA

SEQ ID NO: 1388484 - protein, 9 aa, Homo Sapiens
WGSLPLRSS

SEQ ID NO: 1388485 - protein, 9 aa, Homo Sapiens
KVLNWSLFT

SEQ ID NO: 1388486 - protein, 9 aa, Homo Sapiens
GDEKGNENE

SEQ ID NO: 1388487 - protein, 9 aa, Homo Sapiens
GGSFSSNLI

SEQ ID NO: 1388488 - protein, 9 aa, Homo Sapiens
RQSTGSAPR

SEQ ID NO: 1388489 - protein, 9 aa, Homo Sapiens
EIQKECLRL

SEQ ID NO: 1388490 - protein, 9 aa, Homo Sapiens
KAQPTLPLP

SEQ ID NO: 1388491 - protein, 9 aa, Homo Sapiens
RAGFQWGES

SEQ ID NO: 1388492 - protein, 9 aa, Homo Sapiens
RFKVLLMLG

SEQ ID NO: 1388493 - protein, 9 aa, Homo Sapiens
VREALEKLH

SEQ ID NO: 1388494 - protein, 9 aa, Homo Sapiens
QLAEPLWKE

SEQ ID NO: 1388495 - protein, 9 aa, Homo Sapiens
PFQSPTKRL

SEQ ID NO: 1388496 - protein, 9 aa, Homo Sapiens
IDGVGIFSF

SEQ ID NO: 1388497 - protein, 9 aa, Homo Sapiens
GVKIVMCWR

SEQ ID NO: 1388498 - protein, 9 aa, Homo Sapiens
ENGLVAYED

SEQ ID NO: 1388499 - protein, 9 aa, Homo Sapiens
ASTWAPVTS

SEQ ID NO: 1388500 - protein, 9 aa, Homo Sapiens
HVFGKSDEL

SEQ ID NO: 1388501 - protein, 9 aa, Homo Sapiens
RSPQAHKLW

SEQ ID NO: 1388502 - protein, 9 aa, Homo Sapiens
HSDVEYAKE

SEQ ID NO: 1388503 - protein, 9 aa, Homo Sapiens
MPASQTQIP

SEQ ID NO: 1388504 - protein, 9 aa, Homo Sapiens
INHANLISA

SEQ ID NO: 1388505 - protein, 9 aa, Homo Sapiens
SGSETGLCG

SEQ ID NO: 1388506 - protein, 9 aa, Homo Sapiens
TDDDMAMCF

SEQ ID NO: 1388507 - protein, 9 aa, Homo Sapiens
NECTGKHPR

SEQ ID NO: 1388508 - protein, 9 aa, Homo Sapiens
EELHSRRMS

SEQ ID NO: 1388509 - protein, 9 aa, Homo Sapiens
SKEVAVGQV

SEQ ID NO: 1388510 - protein, 9 aa, Homo Sapiens
ESLEASPTT

SEQ ID NO: 1388511 - protein, 9 aa, Homo Sapiens
KKRGKSQGG

SEQ ID NO: 1388512 - protein, 9 aa, Homo Sapiens
YTACLDFLW

SEQ ID NO: 1388513 - protein, 9 aa, Homo Sapiens
MDTALGWSK

SEQ ID NO: 1388514 - protein, 9 aa, Homo Sapiens
PRRLGAGAG

SEQ ID NO: 1388515 - protein, 9 aa, Homo Sapiens
QDGCNDGSV

SEQ ID NO: 1388516 - protein, 9 aa, Homo Sapiens
SRLFRVEFS

SEQ ID NO: 1388517 - protein, 9 aa, Homo Sapiens
RSLLSFRDG

SEQ ID NO: 1388518 - protein, 9 aa, Homo Sapiens
QTRWWRGNT

SEQ ID NO: 1388519 - protein, 9 aa, Homo Sapiens
ENSAQGIRE

SEQ ID NO: 1388520 - protein, 9 aa, Homo Sapiens
PTDTFLQIL

SEQ ID NO: 1388521 - protein, 9 aa, Homo Sapiens
WLWYHQVVG

SEQ ID NO: 1388522 - protein, 9 aa, Homo Sapiens
STRYIYLLV

SEQ ID NO: 1388523 - protein, 9 aa, Homo Sapiens
DGEELATPP

SEQ ID NO: 1388524 - protein, 9 aa, Homo Sapiens
RGSLHKTRP

SEQ ID NO: 1388525 - protein, 9 aa, Homo Sapiens
EREDDRVGA

SEQ ID NO: 1388526 - protein, 9 aa, Homo Sapiens
GRALPLQLL

SEQ ID NO: 1388527 - protein, 9 aa, Homo Sapiens
VENVNPYEV

SEQ ID NO: 1388528 - protein, 9 aa, Homo Sapiens
AQTRWWRGN

SEQ ID NO: 1388529 - protein, 9 aa, Homo Sapiens
KGGFGEVCT

SEQ ID NO: 1388530 - protein, 9 aa, Homo Sapiens
SLLGLLILL

SEQ ID NO: 1388531 - protein, 9 aa, Homo Sapiens
FGGNITQHS

SEQ ID NO: 1388532 - protein, 9 aa, Homo Sapiens
GHELPGGLR

SEQ ID NO: 1388533 - protein, 9 aa, Homo Sapiens
SHRGLSSPR

SEQ ID NO: 1388534 - protein, 9 aa, Homo Sapiens
FHVLALEVT

SEQ ID NO: 1388535 - protein, 9 aa, Homo Sapiens
HWSMQNFSP

SEQ ID NO: 1388536 - protein, 9 aa, Homo Sapiens
TLGFMSSTS

SEQ ID NO: 1388537 - protein, 9 aa, Homo Sapiens
ANNLCLDER

SEQ ID NO: 1388538 - protein, 9 aa, Homo Sapiens
TKMVEKAKT

SEQ ID NO: 1388539 - protein, 9 aa, Homo Sapiens
GGQFRAGPT

SEQ ID NO: 1388540 - protein, 9 aa, Homo Sapiens
RDVPQETRS

SEQ ID NO: 1388541 - protein, 9 aa, Homo Sapiens
MPLMIFANW

SEQ ID NO: 1388542 - protein, 9 aa, Homo Sapiens
AAAGSQDVG

SEQ ID NO: 1388543 - protein, 9 aa, Homo Sapiens
GGVPPQQTR

SEQ ID NO: 1388544 - protein, 9 aa, Homo Sapiens
CIQEALHEH

SEQ ID NO: 1388545 - protein, 9 aa, Homo Sapiens
MNSGFGKIL

SEQ ID NO: 1388546 - protein, 9 aa, Homo Sapiens
EHLMLEELR

SEQ ID NO: 1388547 - protein, 9 aa, Homo Sapiens
YSALIAGSS

SEQ ID NO: 1388548 - protein, 9 aa, Homo Sapiens
KTWTFSPRV

SEQ ID NO: 1388549 - protein, 9 aa, Homo Sapiens
KHWCPGLKI

SEQ ID NO: 1388550 - protein, 9 aa, Homo Sapiens
EDQDWEFMV

SEQ ID NO: 1388551 - protein, 9 aa, Homo Sapiens
RGTGVNLGQ

SEQ ID NO: 1388552 - protein, 9 aa, Homo Sapiens
RGHKSALLG

SEQ ID NO: 1388553 - protein, 9 aa, Homo Sapiens
AADMMVDFR

SEQ ID NO: 1388554 - protein, 9 aa, Homo Sapiens
PYECKDRGK

SEQ ID NO: 1388555 - protein, 9 aa, Homo Sapiens
IIGGFWLSL

SEQ ID NO: 1388556 - protein, 9 aa, Homo Sapiens
PAVPSSCTY

SEQ ID NO: 1388557 - protein, 9 aa, Homo Sapiens
DTDYMLSEE

SEQ ID NO: 1388558 - protein, 9 aa, Homo Sapiens
YWVPVEYAE

SEQ ID NO: 1388559 - protein, 9 aa, Homo Sapiens
RRSSSAWAP

SEQ ID NO: 1388560 - protein, 9 aa, Homo Sapiens
CSWQVLQRK

SEQ ID NO: 1388561 - protein, 9 aa, Homo Sapiens
LSLQQWKRP

SEQ ID NO: 1388562 - protein, 9 aa, Homo Sapiens
RTSGLVVSL

SEQ ID NO: 1388563 - protein, 9 aa, Homo Sapiens
PRQAEIQKE

SEQ ID NO: 1388564 - protein, 9 aa, Homo Sapiens
QVRCIPNTF

SEQ ID NO: 1388565 - protein, 9 aa, Homo Sapiens
EHFGPDAVA

SEQ ID NO: 1388566 - protein, 9 aa, Homo Sapiens
LTINPAKCI

SEQ ID NO: 1388567 - protein, 9 aa, Homo Sapiens
KNNFRLRGY

SEQ ID NO: 1388568 - protein, 9 aa, Homo Sapiens
QEREYIHQG

SEQ ID NO: 1388569 - protein, 9 aa, Homo Sapiens
LQRKKLSDT

SEQ ID NO: 1388570 - protein, 9 aa, Homo Sapiens
SPSTQTTAT

SEQ ID NO: 1388571 - protein, 9 aa, Homo Sapiens
LGSPKRQKR

SEQ ID NO: 1388572 - protein, 9 aa, Homo Sapiens
EIANNLCLD

SEQ ID NO: 1388573 - protein, 9 aa, Homo Sapiens
LSQEATRRY

SEQ ID NO: 1388574 - protein, 9 aa, Homo Sapiens
GTLGLVASL

SEQ ID NO: 1388575 - protein, 9 aa, Homo Sapiens
WAPVTSTWM

SEQ ID NO: 1388576 - protein, 9 aa, Homo Sapiens
TCPPWTLRM

SEQ ID NO: 1388577 - protein, 9 aa, Homo Sapiens
ACWSPWASS

SEQ ID NO: 1388578 - protein, 9 aa, Homo Sapiens
WLSWRRWGT

SEQ ID NO: 1388579 - protein, 9 aa, Homo Sapiens
RWEQLLEAL

SEQ ID NO: 1388580 - protein, 9 aa, Homo Sapiens
LSSTLERLT

SEQ ID NO: 1388581 - protein, 9 aa, Homo Sapiens
FSVELMDHK

SEQ ID NO: 1388582 - protein, 9 aa, Homo Sapiens
SKGDEKGNE

SEQ ID NO: 1388583 - protein, 9 aa, Homo Sapiens
QIQAFMNSG

SEQ ID NO: 1388584 - protein, 9 aa, Homo Sapiens
KMHGTVDCN

SEQ ID NO: 1388585 - protein, 9 aa, Homo Sapiens
QCEFEGCDW

SEQ ID NO: 1388586 - protein, 9 aa, Homo Sapiens
KIQHSITTQ

SEQ ID NO: 1388587 - protein, 9 aa, Homo Sapiens
CQRKAQRPP

SEQ ID NO: 1388588 - protein, 9 aa, Homo Sapiens
PIYSCNVFL

SEQ ID NO: 1388589 - protein, 9 aa, Homo Sapiens
LRTPLTLAG

SEQ ID NO: 1388590 - protein, 9 aa, Homo Sapiens
LSTLSQPPP

SEQ ID NO: 1388591 - protein, 9 aa, Homo Sapiens
RALLTQPPT

SEQ ID NO: 1388592 - protein, 9 aa, Homo Sapiens
LDANKINCL

SEQ ID NO: 1388593 - protein, 9 aa, Homo Sapiens
ILVFTFAST

SEQ ID NO: 1388594 - protein, 9 aa, Homo Sapiens
YQHNWLPAR

SEQ ID NO: 1388595 - protein, 9 aa, Homo Sapiens
ASRLPRMPG

SEQ ID NO: 1388596 - protein, 9 aa, Homo Sapiens
WICSMKMVL

SEQ ID NO: 1388597 - protein, 9 aa, Homo Sapiens
LQCLTEYME

SEQ ID NO: 1388598 - protein, 9 aa, Homo Sapiens
TLASAHVGV

SEQ ID NO: 1388599 - protein, 9 aa, Homo Sapiens
AMQPVQFSQ

SEQ ID NO: 1388600 - protein, 9 aa, Homo Sapiens
AVRKPLEAM

SEQ ID NO: 1388601 - protein, 9 aa, Homo Sapiens
GIKEPNSKN

SEQ ID NO: 1388602 - protein, 9 aa, Homo Sapiens
HVSVEFQGL

SEQ ID NO: 1388603 - protein, 9 aa, Homo Sapiens
VMIQKVILW

SEQ ID NO: 1388604 - protein, 9 aa, Homo Sapiens
PDQDCDKIK

SEQ ID NO: 1388605 - protein, 9 aa, Homo Sapiens
PGRVAEPAV

SEQ ID NO: 1388606 - protein, 9 aa, Homo Sapiens
KQCVKALSY

SEQ ID NO: 1388607 - protein, 9 aa, Homo Sapiens
STTPGLEHQ

SEQ ID NO: 1388608 - protein, 9 aa, Homo Sapiens
APQREASTW

SEQ ID NO: 1388609 - protein, 9 aa, Homo Sapiens
GAEDPCFIF

SEQ ID NO: 1388610 - protein, 9 aa, Homo Sapiens
LIQQAMMVS

SEQ ID NO: 1388611 - protein, 9 aa, Homo Sapiens
AWRSRASGW

SEQ ID NO: 1388612 - protein, 9 aa, Homo Sapiens
CRLYMQFQE

SEQ ID NO: 1388613 - protein, 9 aa, Homo Sapiens
PLTLAGPPR

SEQ ID NO: 1388614 - protein, 9 aa, Homo Sapiens
KTPEQFPFT

SEQ ID NO: 1388615 - protein, 9 aa, Homo Sapiens
LRKCAKITS

SEQ ID NO: 1388616 - protein, 9 aa, Homo Sapiens
DPNYWIQAH

SEQ ID NO: 1388617 - protein, 9 aa, Homo Sapiens
RQPWVLRVT

SEQ ID NO: 1388618 - protein, 9 aa, Homo Sapiens
PRPGQPTAL

SEQ ID NO: 1388619 - protein, 9 aa, Homo Sapiens
YLAATSASG

SEQ ID NO: 1388620 - protein, 9 aa, Homo Sapiens
KFTDFGTYI

SEQ ID NO: 1388621 - protein, 9 aa, Homo Sapiens
VSSTTTGPC

SEQ ID NO: 1388622 - protein, 9 aa, Homo Sapiens
SSFLIFFIP

SEQ ID NO: 1388623 - protein, 9 aa, Homo Sapiens
CAERVGNMA

SEQ ID NO: 1388624 - protein, 9 aa, Homo Sapiens
ILNVALTSL

SEQ ID NO: 1388625 - protein, 9 aa, Homo Sapiens
LGLVASLWG

SEQ ID NO: 1388626 - protein, 9 aa, Homo Sapiens
PLPPAMKHY

SEQ ID NO: 1388627 - protein, 9 aa, Homo Sapiens
LDDRHWSMQ

SEQ ID NO: 1388628 - protein, 9 aa, Homo Sapiens
RSFEGILYK

SEQ ID NO: 1388629 - protein, 9 aa, Homo Sapiens
MTCPPWTLR

SEQ ID NO: 1388630 - protein, 9 aa, Homo Sapiens
EQVAMRCAI

SEQ ID NO: 1388631 - protein, 9 aa, Homo Sapiens
RWWRGNTRK

SEQ ID NO: 1388632 - protein, 9 aa, Homo Sapiens
ARQLRKQKK

SEQ ID NO: 1388633 - protein, 9 aa, Homo Sapiens
DQLPMTSRY

SEQ ID NO: 1388634 - protein, 9 aa, Homo Sapiens
GGANPLMKP

SEQ ID NO: 1388635 - protein, 9 aa, Homo Sapiens
RSQRRRRYR

SEQ ID NO: 1388636 - protein, 9 aa, Homo Sapiens
VLKHPLLSF

SEQ ID NO: 1388637 - protein, 9 aa, Homo Sapiens
STWMTCPPW

SEQ ID NO: 1388638 - protein, 9 aa, Homo Sapiens
PIISETPLP

SEQ ID NO: 1388639 - protein, 9 aa, Homo Sapiens
QLKVMDRQS

SEQ ID NO: 1388640 - protein, 9 aa, Homo Sapiens
DLVLSLPRV

SEQ ID NO: 1388641 - protein, 9 aa, Homo Sapiens
RKGLPFHVD

SEQ ID NO: 1388642 - protein, 9 aa, Homo Sapiens
LFTPLHHPE

SEQ ID NO: 1388643 - protein, 9 aa, Homo Sapiens
LPKLKHMSH

SEQ ID NO: 1388644 - protein, 9 aa, Homo Sapiens
KFLKILEGD

SEQ ID NO: 1388645 - protein, 9 aa, Homo Sapiens
ESSHLQAHQ

SEQ ID NO: 1388646 - protein, 9 aa, Homo Sapiens
SATREPSSV

SEQ ID NO: 1388647 - protein, 9 aa, Homo Sapiens
PCWWTMGLR

SEQ ID NO: 1388648 - protein, 9 aa, Homo Sapiens
ILGTDILLI

SEQ ID NO: 1388649 - protein, 9 aa, Homo Sapiens
RGRGRFMFQ

SEQ ID NO: 1388650 - protein, 9 aa, Homo Sapiens
GGWPTSSCC

SEQ ID NO: 1388651 - protein, 9 aa, Homo Sapiens
RCLCADYFK

SEQ ID NO: 1388652 - protein, 9 aa, Homo Sapiens
HVHVSFGPG

SEQ ID NO: 1388653 - protein, 9 aa, Homo Sapiens
RSAHKEEED

SEQ ID NO: 1388654 - protein, 9 aa, Homo Sapiens
RPGLQGPPG

SEQ ID NO: 1388655 - protein, 9 aa, Homo Sapiens
PQMQLQALA

SEQ ID NO: 1388656 - protein, 9 aa, Homo Sapiens
RSKEPNLVL

SEQ ID NO: 1388657 - protein, 9 aa, Homo Sapiens
VRVGKGNVT

SEQ ID NO: 1388658 - protein, 9 aa, Homo Sapiens
AGFPPRVEC

SEQ ID NO: 1388659 - protein, 9 aa, Homo Sapiens
YIPHVHVSF

SEQ ID NO: 1388660 - protein, 9 aa, Homo Sapiens
AVIEAKKRI

SEQ ID NO: 1388661 - protein, 9 aa, Homo Sapiens
GTWTTTSCM

SEQ ID NO: 1388662 - protein, 9 aa, Homo Sapiens
AILTGVYAL

SEQ ID NO: 1388663 - protein, 9 aa, Homo Sapiens
SAPSAPVSG

SEQ ID NO: 1388664 - protein, 9 aa, Homo Sapiens
AAQDGARCP

SEQ ID NO: 1388665 - protein, 9 aa, Homo Sapiens
DITAWGGEF

SEQ ID NO: 1388666 - protein, 9 aa, Homo Sapiens
HENYVACSC

SEQ ID NO: 1388667 - protein, 9 aa, Homo Sapiens
LVVSLWGWS

SEQ ID NO: 1388668 - protein, 9 aa, Homo Sapiens
WRRAPAVLD

SEQ ID NO: 1388669 - protein, 9 aa, Homo Sapiens
DVPQETRSS

SEQ ID NO: 1388670 - protein, 9 aa, Homo Sapiens
HEALQLCRP

SEQ ID NO: 1388671 - protein, 9 aa, Homo Sapiens
QPQPDPHLC

SEQ ID NO: 1388672 - protein, 9 aa, Homo Sapiens
SMTEEKFTV

SEQ ID NO: 1388673 - protein, 9 aa, Homo Sapiens
NNLCLDERQ

SEQ ID NO: 1388674 - protein, 9 aa, Homo Sapiens
PVIYVFMNQ

SEQ ID NO: 1388675 - protein, 9 aa, Homo Sapiens
KLWMIVIIK

SEQ ID NO: 1388676 - protein, 9 aa, Homo Sapiens
KHPLLSFKQ

SEQ ID NO: 1388677 - protein, 9 aa, Homo Sapiens
VTVTPRESM

SEQ ID NO: 1388678 - protein, 9 aa, Homo Sapiens
YNRRLKSMP

SEQ ID NO: 1388679 - protein, 9 aa, Homo Sapiens
LTPSRWAPR

SEQ ID NO: 1388680 - protein, 9 aa, Homo Sapiens
AFMNSGFGK

SEQ ID NO: 1388681 - protein, 9 aa, Homo Sapiens
LHSFYHTGG

SEQ ID NO: 1388682 - protein, 9 aa, Homo Sapiens
LSTSTEEME

SEQ ID NO: 1388683 - protein, 9 aa, Homo Sapiens
RDGCHRLPQ

SEQ ID NO: 1388684 - protein, 9 aa, Homo Sapiens
TLDLVLSLP

SEQ ID NO: 1388685 - protein, 9 aa, Homo Sapiens
RRSPQAHKL

SEQ ID NO: 1388686 - protein, 9 aa, Homo Sapiens
KRKEAELCQ

SEQ ID NO: 1388687 - protein, 9 aa, Homo Sapiens
CKVFKRAME

SEQ ID NO: 1388688 - protein, 9 aa, Homo Sapiens
SPADDPLAD

SEQ ID NO: 1388689 - protein, 9 aa, Homo Sapiens
PRKVAGGHS

SEQ ID NO: 1388690 - protein, 9 aa, Homo Sapiens
TTKKASAIA

SEQ ID NO: 1388691 - protein, 9 aa, Homo Sapiens
VTAKKPGGA

SEQ ID NO: 1388692 - protein, 9 aa, Homo Sapiens
FLIKQRKKV

SEQ ID NO: 1388693 - protein, 9 aa, Homo Sapiens
LKVMDRQSF

SEQ ID NO: 1388694 - protein, 9 aa, Homo Sapiens
VKALKKKPL

SEQ ID NO: 1388695 - protein, 9 aa, Homo Sapiens
SMMYITSKP

SEQ ID NO: 1388696 - protein, 9 aa, Homo Sapiens
DINSHTGRS

SEQ ID NO: 1388697 - protein, 9 aa, Homo Sapiens
QARLALPAT

SEQ ID NO: 1388698 - protein, 9 aa, Homo Sapiens
DSIKPDLIQ

SEQ ID NO: 1388699 - protein, 9 aa, Homo Sapiens
LVTAKKPGG

SEQ ID NO: 1388700 - protein, 9 aa, Homo Sapiens
NRSPPELVV

SEQ ID NO: 1388701 - protein, 9 aa, Homo Sapiens
EDSGTETSS

SEQ ID NO: 1388702 - protein, 9 aa, Homo Sapiens
AWPHLTEGI

SEQ ID NO: 1388703 - protein, 9 aa, Homo Sapiens
AMWEKGWDK

SEQ ID NO: 1388704 - protein, 9 aa, Homo Sapiens
QREASTWAP

SEQ ID NO: 1388705 - protein, 9 aa, Homo Sapiens
KNFCLKIYD

SEQ ID NO: 1388706 - protein, 9 aa, Homo Sapiens
GKYVNFITN

SEQ ID NO: 1388707 - protein, 9 aa, Homo Sapiens
PEDECWTGH

SEQ ID NO: 1388708 - protein, 9 aa, Homo Sapiens
VTSQEAMPH

SEQ ID NO: 1388709 - protein, 9 aa, Homo Sapiens
WWPHGAYCV

SEQ ID NO: 1388710 - protein, 9 aa, Homo Sapiens
PWMPCTTSH

SEQ ID NO: 1388711 - protein, 9 aa, Homo Sapiens
FSFSLCNFS

SEQ ID NO: 1388712 - protein, 9 aa, Homo Sapiens
KEKTAKMKK

SEQ ID NO: 1388713 - protein, 9 aa, Homo Sapiens
FRASLSTLG

SEQ ID NO: 1388714 - protein, 9 aa, Homo Sapiens
LLDGGSNRG

SEQ ID NO: 1388715 - protein, 9 aa, Homo Sapiens
KIQENYGDV

SEQ ID NO: 1388716 - protein, 9 aa, Homo Sapiens
VNAFMVWSR

SEQ ID NO: 1388717 - protein, 9 aa, Homo Sapiens
LKAVKSSTC

SEQ ID NO: 1388718 - protein, 9 aa, Homo Sapiens
IRSLQHFTT

SEQ ID NO: 1388719 - protein, 9 aa, Homo Sapiens
SQFVTFYSG

SEQ ID NO: 1388720 - protein, 9 aa, Homo Sapiens
NWYLGEERY

SEQ ID NO: 1388721 - protein, 9 aa, Homo Sapiens
WLFWMSPRG

SEQ ID NO: 1388722 - protein, 9 aa, Homo Sapiens
IAVIIYIFP

SEQ ID NO: 1388723 - protein, 9 aa, Homo Sapiens
SHTNKEAIC

SEQ ID NO: 1388724 - protein, 9 aa, Homo Sapiens
LTCHFHVTV

SEQ ID NO: 1388725 - protein, 9 aa, Homo Sapiens
RPSALDRCR

SEQ ID NO: 1388726 - protein, 9 aa, Homo Sapiens
PLVLTVLDE

SEQ ID NO: 1388727 - protein, 9 aa, Homo Sapiens
AMSQPASSS

SEQ ID NO: 1388728 - protein, 9 aa, Homo Sapiens
TKEEYLVVI

SEQ ID NO: 1388729 - protein, 9 aa, Homo Sapiens
SWPWTRCLR

SEQ ID NO: 1388730 - protein, 9 aa, Homo Sapiens
PWRAGFQWG

SEQ ID NO: 1388731 - protein, 9 aa, Homo Sapiens
CLPMIVGSY

SEQ ID NO: 1388732 - protein, 9 aa, Homo Sapiens
GAGSRVCLA

SEQ ID NO: 1388733 - protein, 9 aa, Homo Sapiens
SFEGILYKR

SEQ ID NO: 1388734 - protein, 9 aa, Homo Sapiens
VLQGHVYRF

SEQ ID NO: 1388735 - protein, 9 aa, Homo Sapiens
QCVKALSYK

SEQ ID NO: 1388736 - protein, 9 aa, Homo Sapiens
QPSYNIKSV

SEQ ID NO: 1388737 - protein, 9 aa, Homo Sapiens
ELVLTFNNL

SEQ ID NO: 1388738 - protein, 9 aa, Homo Sapiens
TKQIKTKPT

SEQ ID NO: 1388739 - protein, 9 aa, Homo Sapiens
QVWASAIAQ

SEQ ID NO: 1388740 - protein, 9 aa, Homo Sapiens
FSFQMHIKV

SEQ ID NO: 1388741 - protein, 9 aa, Homo Sapiens
ELVVEIVLV

SEQ ID NO: 1388742 - protein, 9 aa, Homo Sapiens
YSNSTVSET

SEQ ID NO: 1388743 - protein, 9 aa, Homo Sapiens
VHVSFGPGG

SEQ ID NO: 1388744 - protein, 9 aa, Homo Sapiens
LSKLKKNIS

SEQ ID NO: 1388745 - protein, 9 aa, Homo Sapiens
LPSCKMTGK

SEQ ID NO: 1388746 - protein, 9 aa, Homo Sapiens
PDAVAVPFL

SEQ ID NO: 1388747 - protein, 9 aa, Homo Sapiens
SRILPELGL

SEQ ID NO: 1388748 - protein, 9 aa, Homo Sapiens
ATGRRQSRH

SEQ ID NO: 1388749 - protein, 9 aa, Homo Sapiens
PPWPTHLPS

SEQ ID NO: 1388750 - protein, 9 aa, Homo Sapiens
LDLAGSILS

SEQ ID NO: 1388751 - protein, 9 aa, Homo Sapiens
CEHSNTLIQ

SEQ ID NO: 1388752 - protein, 9 aa, Homo Sapiens
LINYYESKI

SEQ ID NO: 1388753 - protein, 9 aa, Homo Sapiens
FNFFWVGGA

SEQ ID NO: 1388754 - protein, 9 aa, Homo Sapiens
VKAKPISDN

SEQ ID NO: 1388755 - protein, 9 aa, Homo Sapiens
YLPWASSVL

SEQ ID NO: 1388756 - protein, 9 aa, Homo Sapiens
DLTSQEILL

SEQ ID NO: 1388757 - protein, 9 aa, Homo Sapiens
TRTTAQLQA

SEQ ID NO: 1388758 - protein, 9 aa, Homo Sapiens
YGHKINDPW

SEQ ID NO: 1388759 - protein, 9 aa, Homo Sapiens
PSTQTTATC

SEQ ID NO: 1388760 - protein, 9 aa, Homo Sapiens
VQQVQLDPG

SEQ ID NO: 1388761 - protein, 9 aa, Homo Sapiens
QTEGTWDQD

SEQ ID NO: 1388762 - protein, 9 aa, Homo Sapiens
TPLRTPLTL

SEQ ID NO: 1388763 - protein, 9 aa, Homo Sapiens
FSCFFSVEL

SEQ ID NO: 1388764 - protein, 9 aa, Homo Sapiens
TWAPVTSTW

SEQ ID NO: 1388765 - protein, 9 aa, Homo Sapiens
EMEEMKRRI

SEQ ID NO: 1388766 - protein, 9 aa, Homo Sapiens
MFISDDESF

SEQ ID NO: 1388767 - protein, 9 aa, Homo Sapiens
WVPVEYAEE

SEQ ID NO: 1388768 - protein, 9 aa, Homo Sapiens
ARSKYSGTH

SEQ ID NO: 1388769 - protein, 9 aa, Homo Sapiens
RSSQSLGRP

SEQ ID NO: 1388770 - protein, 9 aa, Homo Sapiens
NRGSCSSWR

SEQ ID NO: 1388771 - protein, 9 aa, Homo Sapiens
LPLLESSTE

SEQ ID NO: 1388772 - protein, 9 aa, Homo Sapiens
EEDGDEVEE

SEQ ID NO: 1388773 - protein, 9 aa, Homo Sapiens
GGPCILYCA

SEQ ID NO: 1388774 - protein, 9 aa, Homo Sapiens
VGIVLKVVS

SEQ ID NO: 1388775 - protein, 9 aa, Homo Sapiens
RIKRKKKKR

SEQ ID NO: 1388776 - protein, 9 aa, Homo Sapiens
QTSSHTNSS

SEQ ID NO: 1388777 - protein, 9 aa, Homo Sapiens
EGGCASGTW

SEQ ID NO: 1388778 - protein, 9 aa, Homo Sapiens
KNPSLVCVT

SEQ ID NO: 1388779 - protein, 9 aa, Homo Sapiens
PGLQGPPGA

SEQ ID NO: 1388780 - protein, 9 aa, Homo Sapiens
ACVIMEMLR

SEQ ID NO: 1388781 - protein, 9 aa, Homo Sapiens
ISGILEHYV

SEQ ID NO: 1388782 - protein, 9 aa, Homo Sapiens
WQGVPLSPC

SEQ ID NO: 1388783 - protein, 9 aa, Homo Sapiens
KNFRKEKNS

SEQ ID NO: 1388784 - protein, 9 aa, Homo Sapiens
PDLRGRGVA

SEQ ID NO: 1388785 - protein, 9 aa, Homo Sapiens
PVPMGSISV

SEQ ID NO: 1388786 - protein, 9 aa, Homo Sapiens
CFESLRMRY

SEQ ID NO: 1388787 - protein, 9 aa, Homo Sapiens
ATHHVAADM

SEQ ID NO: 1388788 - protein, 9 aa, Homo Sapiens
SFISSQSFS

SEQ ID NO: 1388789 - protein, 9 aa, Homo Sapiens
RAAPPSLRA

SEQ ID NO: 1388790 - protein, 9 aa, Homo Sapiens
WLLEVNLSF

SEQ ID NO: 1388791 - protein, 9 aa, Homo Sapiens
RFLTLASAH

SEQ ID NO: 1388792 - protein, 9 aa, Homo Sapiens
PMGSISVVG

SEQ ID NO: 1388793 - protein, 9 aa, Homo Sapiens
SQSLGRPGR

SEQ ID NO: 1388794 - protein, 9 aa, Homo Sapiens
GTLRFVASL

SEQ ID NO: 1388795 - protein, 9 aa, Homo Sapiens
YHTGGSHCS

SEQ ID NO: 1388796 - protein, 9 aa, Homo Sapiens
FAQGMRRNL

SEQ ID NO: 1388797 - protein, 9 aa, Homo Sapiens
EYTACLDFL

SEQ ID NO: 1388798 - protein, 9 aa, Homo Sapiens
TTHRDMLLS

SEQ ID NO: 1388799 - protein, 9 aa, Homo Sapiens
MKVQSQAPL

SEQ ID NO: 1388800 - protein, 9 aa, Homo Sapiens
PPEWKCSPL

SEQ ID NO: 1388801 - protein, 9 aa, Homo Sapiens
IQQAMMVSE

SEQ ID NO: 1388802 - protein, 9 aa, Homo Sapiens
AGPAAALCS

SEQ ID NO: 1388803 - protein, 9 aa, Homo Sapiens
SLWGWSLWL

SEQ ID NO: 1388804 - protein, 9 aa, Homo Sapiens
KTRTSLHQA

SEQ ID NO: 1388805 - protein, 9 aa, Homo Sapiens
PGIAHLPLP

SEQ ID NO: 1388806 - protein, 9 aa, Homo Sapiens
GGRTAAVGK

SEQ ID NO: 1388807 - protein, 9 aa, Homo Sapiens
PGRRDPQDG

SEQ ID NO: 1388808 - protein, 9 aa, Homo Sapiens
HWKLQTHPS

SEQ ID NO: 1388809 - protein, 9 aa, Homo Sapiens
HAPPVAEEA

SEQ ID NO: 1388810 - protein, 9 aa, Homo Sapiens
ATVQAFLKR

SEQ ID NO: 1388811 - protein, 9 aa, Homo Sapiens
QPQPMEKSD

SEQ ID NO: 1388812 - protein, 9 aa, Homo Sapiens
FHLSRILPE

SEQ ID NO: 1388813 - protein, 9 aa, Homo Sapiens
PQEAVCVAG

SEQ ID NO: 1388814 - protein, 9 aa, Homo Sapiens
KREKIINPT

SEQ ID NO: 1388815 - protein, 9 aa, Homo Sapiens
CSDSETSST

SEQ ID NO: 1388816 - protein, 9 aa, Homo Sapiens
AYISCSSLK

SEQ ID NO: 1388817 - protein, 9 aa, Homo Sapiens
RGIKEPNSK

SEQ ID NO: 1388818 - protein, 9 aa, Homo Sapiens
THKNSYWRE

SEQ ID NO: 1388819 - protein, 9 aa, Homo Sapiens
GSQTSSHTN

SEQ ID NO: 1388820 - protein, 9 aa, Homo Sapiens
VCVTTIADI

SEQ ID NO: 1388821 - protein, 9 aa, Homo Sapiens
SRDVPQETR

SEQ ID NO: 1388822 - protein, 9 aa, Homo Sapiens
VPMNSLVPS

SEQ ID NO: 1388823 - protein, 9 aa, Homo Sapiens
KLCCGSSWY

SEQ ID NO: 1388824 - protein, 9 aa, Homo Sapiens
KRMDSIKPD

SEQ ID NO: 1388825 - protein, 9 aa, Homo Sapiens
PPDVIAKKQ

SEQ ID NO: 1388826 - protein, 9 aa, Homo Sapiens
ALSWRGLHS

SEQ ID NO: 1388827 - protein, 9 aa, Homo Sapiens
PHVHVSFGP

SEQ ID NO: 1388828 - protein, 9 aa, Homo Sapiens
VTVLLTRTT

SEQ ID NO: 1388829 - protein, 9 aa, Homo Sapiens
GGRHPSWPW

SEQ ID NO: 1388830 - protein, 9 aa, Homo Sapiens
VAVGQVLKG

SEQ ID NO: 1388831 - protein, 9 aa, Homo Sapiens
ERKGLPFHV

SEQ ID NO: 1388832 - protein, 9 aa, Homo Sapiens
PPNLTTKKC

SEQ ID NO: 1388833 - protein, 9 aa, Homo Sapiens
CLKKGIKIY

SEQ ID NO: 1388834 - protein, 9 aa, Homo Sapiens
SPTKIETLF

SEQ ID NO: 1388835 - protein, 9 aa, Homo Sapiens
YLAAVLECL

SEQ ID NO: 1388836 - protein, 9 aa, Homo Sapiens
SQVIETTNV

SEQ ID NO: 1388837 - protein, 9 aa, Homo Sapiens
LERLTNSLM

SEQ ID NO: 1388838 - protein, 9 aa, Homo Sapiens
RRRGAGVSP

SEQ ID NO: 1388839 - protein, 9 aa, Homo Sapiens
SQNDAYNDC

SEQ ID NO: 1388840 - protein, 9 aa, Homo Sapiens
DEKGNENED

SEQ ID NO: 1388841 - protein, 9 aa, Homo Sapiens
HLSRILPEL

SEQ ID NO: 1388842 - protein, 9 aa, Homo Sapiens
AYNKINKIT

SEQ ID NO: 1388843 - protein, 9 aa, Homo Sapiens
AIPTVLSSS

SEQ ID NO: 1388844 - protein, 9 aa, Homo Sapiens
SQQSLSLQQ

SEQ ID NO: 1388845 - protein, 9 aa, Homo Sapiens
EATRRYGEL

SEQ ID NO: 1388846 - protein, 9 aa, Homo Sapiens
RVSRGKAPQ

SEQ ID NO: 1388847 - protein, 9 aa, Homo Sapiens
RLPRMPGPP

SEQ ID NO: 1388848 - protein, 9 aa, Homo Sapiens
TVSETQWKV

SEQ ID NO: 1388849 - protein, 9 aa, Homo Sapiens
LEDQDWEFM

SEQ ID NO: 1388850 - protein, 9 aa, Homo Sapiens
FYFGELPLL

SEQ ID NO: 1388851 - protein, 9 aa, Homo Sapiens
WFYYSTRYI

SEQ ID NO: 1388852 - protein, 9 aa, Homo Sapiens
HFCQFHYSM

SEQ ID NO: 1388853 - protein, 9 aa, Homo Sapiens
LELLSEKKF

SEQ ID NO: 1388854 - protein, 9 aa, Homo Sapiens
LDSSAYESC

SEQ ID NO: 1388855 - protein, 9 aa, Homo Sapiens
NFNMLEALS

SEQ ID NO: 1388856 - protein, 9 aa, Homo Sapiens
GKVHIFKYP

SEQ ID NO: 1388857 - protein, 9 aa, Homo Sapiens
TMGLRPWWM

SEQ ID NO: 1388858 - protein, 9 aa, Homo Sapiens
KGDRSKRGE

SEQ ID NO: 1388859 - protein, 9 aa, Homo Sapiens
WGTLGLVAS

SEQ ID NO: 1388860 - protein, 9 aa, Homo Sapiens
LYFAVDPGK

SEQ ID NO: 1388861 - protein, 9 aa, Homo Sapiens
AAWKKRFAA

SEQ ID NO: 1388862 - protein, 9 aa, Homo Sapiens
DENAVTKID

SEQ ID NO: 1388863 - protein, 9 aa, Homo Sapiens
TKQNKLVLS

SEQ ID NO: 1388864 - protein, 9 aa, Homo Sapiens
QYLAATSAS

SEQ ID NO: 1388865 - protein, 9 aa, Homo Sapiens
RMLQEAERY

SEQ ID NO: 1388866 - protein, 9 aa, Homo Sapiens
TKFLSSSTH

SEQ ID NO: 1388867 - protein, 9 aa, Homo Sapiens
CTLDQICLK

SEQ ID NO: 1388868 - protein, 9 aa, Homo Sapiens
LLAACTNQP

SEQ ID NO: 1388869 - protein, 9 aa, Homo Sapiens
LTRTTAQLQ

SEQ ID NO: 1388870 - protein, 9 aa, Homo Sapiens
KHMQETKKK

SEQ ID NO: 1388871 - protein, 9 aa, Homo Sapiens
LRCVRLLGI

SEQ ID NO: 1388872 - protein, 9 aa, Homo Sapiens
KEEDWKCVL

SEQ ID NO: 1388873 - protein, 9 aa, Homo Sapiens
EEAQKKLYE

SEQ ID NO: 1388874 - protein, 9 aa, Homo Sapiens
EGLGRLPPG

SEQ ID NO: 1388875 - protein, 9 aa, Homo Sapiens
SDLLVGAPC

SEQ ID NO: 1388876 - protein, 9 aa, Homo Sapiens
IPSLSRSLQ

SEQ ID NO: 1388877 - protein, 9 aa, Homo Sapiens
SEFLLLWMS

SEQ ID NO: 1388878 - protein, 9 aa, Homo Sapiens
STSVYPHFL

SEQ ID NO: 1388879 - protein, 9 aa, Homo Sapiens
IPGDRGLQG

SEQ ID NO: 1388880 - protein, 9 aa, Homo Sapiens
EKILSDLLA

SEQ ID NO: 1388881 - protein, 9 aa, Homo Sapiens
GDLPWRGVG

SEQ ID NO: 1388882 - protein, 9 aa, Homo Sapiens
LNTTLPQEF

SEQ ID NO: 1388883 - protein, 9 aa, Homo Sapiens
ENQMAGRPG

SEQ ID NO: 1388884 - protein, 9 aa, Homo Sapiens
SVRIVKNWV

SEQ ID NO: 1388885 - protein, 9 aa, Homo Sapiens
QLLEALAVH

SEQ ID NO: 1388886 - protein, 9 aa, Homo Sapiens
ALSFTKQNK

SEQ ID NO: 1388887 - protein, 9 aa, Homo Sapiens
SVTLGDEVF

SEQ ID NO: 1388888 - protein, 9 aa, Homo Sapiens
VCGNRRGSV

SEQ ID NO: 1388889 - protein, 9 aa, Homo Sapiens
GNITQHSIP

SEQ ID NO: 1388890 - protein, 9 aa, Homo Sapiens
TPGLEHQHS

SEQ ID NO: 1388891 - protein, 9 aa, Homo Sapiens
HVPGPGKPT

SEQ ID NO: 1388892 - protein, 9 aa, Homo Sapiens
KLDRLGEGT

SEQ ID NO: 1388893 - protein, 9 aa, Homo Sapiens
DVKAKPISD

SEQ ID NO: 1388894 - protein, 9 aa, Homo Sapiens
LDQLPMTSR

SEQ ID NO: 1388895 - protein, 9 aa, Homo Sapiens
GMDTALGWS

SEQ ID NO: 1388896 - protein, 9 aa, Homo Sapiens
DVPEGLGRL

SEQ ID NO: 1388897 - protein, 9 aa, Homo Sapiens
AISAYVRVG

SEQ ID NO: 1388898 - protein, 9 aa, Homo Sapiens
LCQTQANGF

SEQ ID NO: 1388899 - protein, 9 aa, Homo Sapiens
SVFETLPGR

SEQ ID NO: 1388900 - protein, 9 aa, Homo Sapiens
PGDLPWRGV

SEQ ID NO: 1388901 - protein, 9 aa, Homo Sapiens
YVSPSEEEL

SEQ ID NO: 1388902 - protein, 9 aa, Homo Sapiens
DGLLCSSKS

SEQ ID NO: 1388903 - protein, 9 aa, Homo Sapiens
LCHGGLSVA

SEQ ID NO: 1388904 - protein, 9 aa, Homo Sapiens
IIFVLLLSA

SEQ ID NO: 1388905 - protein, 9 aa, Homo Sapiens
GSLAAMQPV

SEQ ID NO: 1388906 - protein, 9 aa, Homo Sapiens
RRNQSQNQR

SEQ ID NO: 1388907 - protein, 9 aa, Homo Sapiens
AALPGQPPS

SEQ ID NO: 1388908 - protein, 9 aa, Homo Sapiens
GRFMFQKSS

SEQ ID NO: 1388909 - protein, 9 aa, Homo Sapiens
AMGQTTQCL

SEQ ID NO: 1388910 - protein, 9 aa, Homo Sapiens
TAKKPGGAA

SEQ ID NO: 1388911 - protein, 9 aa, Homo Sapiens
SCMWLWMSS

SEQ ID NO: 1388912 - protein, 9 aa, Homo Sapiens
RNLPGIAHL

SEQ ID NO: 1388913 - protein, 9 aa, Homo Sapiens
GGPGSGMEM

SEQ ID NO: 1388914 - protein, 9 aa, Homo Sapiens
TTRPCRRSS

SEQ ID NO: 1388915 - protein, 9 aa, Homo Sapiens
DEVFDRKKR

SEQ ID NO: 1388916 - protein, 9 aa, Homo Sapiens
DPWKNPALW

SEQ ID NO: 1388917 - protein, 9 aa, Homo Sapiens
CQTQANGFM

SEQ ID NO: 1388918 - protein, 9 aa, Homo Sapiens
CVPILKSLP

SEQ ID NO: 1388919 - protein, 9 aa, Homo Sapiens
LLCQCDKKR

SEQ ID NO: 1388920 - protein, 9 aa, Homo Sapiens
CCMQKSGLK

SEQ ID NO: 1388921 - protein, 9 aa, Homo Sapiens
TDKARRVIV

SEQ ID NO: 1388922 - protein, 9 aa, Homo Sapiens
ELLSLQTEG

SEQ ID NO: 1388923 - protein, 9 aa, Homo Sapiens
LCFSSEGGT

SEQ ID NO: 1388924 - protein, 9 aa, Homo Sapiens
TCHFHVTVF

SEQ ID NO: 1388925 - protein, 9 aa, Homo Sapiens
VYIMSTTGW

SEQ ID NO: 1388926 - protein, 9 aa, Homo Sapiens
DRSLSTSTE

SEQ ID NO: 1388927 - protein, 9 aa, Homo Sapiens
HLFLNSNGL

SEQ ID NO: 1388928 - protein, 9 aa, Homo Sapiens
FVLVNLEVT

SEQ ID NO: 1388929 - protein, 9 aa, Homo Sapiens
HRHRGQHAA

SEQ ID NO: 1388930 - protein, 9 aa, Homo Sapiens
DGAGRYFLW

SEQ ID NO: 1388931 - protein, 9 aa, Homo Sapiens
TALHITSLA

SEQ ID NO: 1388932 - protein, 9 aa, Homo Sapiens
SNTLIQQAM

SEQ ID NO: 1388933 - protein, 9 aa, Homo Sapiens
DFSRTASGC

SEQ ID NO: 1388934 - protein, 9 aa, Homo Sapiens
PPSTQFHSL

SEQ ID NO: 1388935 - protein, 9 aa, Homo Sapiens
RSLVLRFKV

SEQ ID NO: 1388936 - protein, 9 aa, Homo Sapiens
SPMAANRTP

SEQ ID NO: 1388937 - protein, 9 aa, Homo Sapiens
EAVCVVYTG

SEQ ID NO: 1388938 - protein, 9 aa, Homo Sapiens
TSCVQQPPY

SEQ ID NO: 1388939 - protein, 9 aa, Homo Sapiens
CLALEGVQT

SEQ ID NO: 1388940 - protein, 9 aa, Homo Sapiens
QQNELKKTY

SEQ ID NO: 1388941 - protein, 9 aa, Homo Sapiens
DSETSSTGS

SEQ ID NO: 1388942 - protein, 9 aa, Homo Sapiens
PGEAALWCG

SEQ ID NO: 1388943 - protein, 9 aa, Homo Sapiens
LSPKSQTLD

SEQ ID NO: 1388944 - protein, 9 aa, Homo Sapiens
TASVVITRG

SEQ ID NO: 1388945 - protein, 9 aa, Homo Sapiens
VACPDLRRQ

SEQ ID NO: 1388946 - protein, 9 aa, Homo Sapiens
SLVLRFKVL

SEQ ID NO: 1388947 - protein, 9 aa, Homo Sapiens
GAERSHGRE

SEQ ID NO: 1388948 - protein, 9 aa, Homo Sapiens
PSEGVIAVP

SEQ ID NO: 1388949 - protein, 9 aa, Homo Sapiens
AVIVGSPIW

SEQ ID NO: 1388950 - protein, 9 aa, Homo Sapiens
QASWNLSQV

SEQ ID NO: 1388951 - protein, 9 aa, Homo Sapiens
MDHPSMHIL

SEQ ID NO: 1388952 - protein, 9 aa, Homo Sapiens
TLEDQDWEF

SEQ ID NO: 1388953 - protein, 9 aa, Homo Sapiens
LNMETLVVV

SEQ ID NO: 1388954 - protein, 9 aa, Homo Sapiens
IAPVELRHV

SEQ ID NO: 1388955 - protein, 9 aa, Homo Sapiens
GDRNICRAE

SEQ ID NO: 1388956 - protein, 9 aa, Homo Sapiens
TSPSNFKVH

SEQ ID NO: 1388957 - protein, 9 aa, Homo Sapiens
RKRKCQKRA

SEQ ID NO: 1388958 - protein, 9 aa, Homo Sapiens
AAMQPVQFS

SEQ ID NO: 1388959 - protein, 9 aa, Homo Sapiens
KELLQKTIR

SEQ ID NO: 1388960 - protein, 9 aa, Homo Sapiens
LIEFEKLSA

SEQ ID NO: 1388961 - protein, 9 aa, Homo Sapiens
TEGGFWKLT

SEQ ID NO: 1388962 - protein, 9 aa, Homo Sapiens
LVVGRFPRE

SEQ ID NO: 1388963 - protein, 9 aa, Homo Sapiens
LYIRNLKSC

SEQ ID NO: 1388964 - protein, 9 aa, Homo Sapiens
AALWCGHEL

SEQ ID NO: 1388965 - protein, 9 aa, Homo Sapiens
VMIPQNVRR

SEQ ID NO: 1388966 - protein, 9 aa, Homo Sapiens
DSGTETSSS

SEQ ID NO: 1388967 - protein, 9 aa, Homo Sapiens
SLPRVPMNS

SEQ ID NO: 1388968 - protein, 9 aa, Homo Sapiens
CGRGALRNT

SEQ ID NO: 1388969 - protein, 9 aa, Homo Sapiens
LQLLWLGAH

SEQ ID NO: 1388970 - protein, 9 aa, Homo Sapiens
QFSLDRGCN

SEQ ID NO: 1388971 - protein, 9 aa, Homo Sapiens
FTPLHHPER

SEQ ID NO: 1388972 - protein, 9 aa, Homo Sapiens
GQQLEYTAC

SEQ ID NO: 1388973 - protein, 9 aa, Homo Sapiens
KGFVASPGR

SEQ ID NO: 1388974 - protein, 9 aa, Homo Sapiens
MSQTVTQSQ

SEQ ID NO: 1388975 - protein, 9 aa, Homo Sapiens
TGPAAPPWL

SEQ ID NO: 1388976 - protein, 9 aa, Homo Sapiens
KKGSKPLCV

SEQ ID NO: 1388977 - protein, 9 aa, Homo Sapiens
PLTNTSATR

SEQ ID NO: 1388978 - protein, 9 aa, Homo Sapiens
KINKITDEA

SEQ ID NO: 1388979 - protein, 9 aa, Homo Sapiens
PCTTSHLEG

SEQ ID NO: 1388980 - protein, 9 aa, Homo Sapiens
EEEDDVEIG

SEQ ID NO: 1388981 - protein, 9 aa, Homo Sapiens
QRHRARQLR

SEQ ID NO: 1388982 - protein, 9 aa, Homo Sapiens
LCADYFKNV

SEQ ID NO: 1388983 - protein, 9 aa, Homo Sapiens
SSSKDSLTC

SEQ ID NO: 1388984 - protein, 9 aa, Homo Sapiens
SVPCVPILK

SEQ ID NO: 1388985 - protein, 9 aa, Homo Sapiens
EEPLESSKN

SEQ ID NO: 1388986 - protein, 9 aa, Homo Sapiens
SLGWCLTGT

SEQ ID NO: 1388987 - protein, 9 aa, Homo Sapiens
GGGAERSHG

SEQ ID NO: 1388988 - protein, 9 aa, Homo Sapiens
DRQGWGWGA

SEQ ID NO: 1388989 - protein, 9 aa, Homo Sapiens
FLILPGSQQ

SEQ ID NO: 1388990 - protein, 9 aa, Homo Sapiens
GMCLTSSMK

SEQ ID NO: 1388991 - protein, 9 aa, Homo Sapiens
QCDTDDDMA

SEQ ID NO: 1388992 - protein, 9 aa, Homo Sapiens
PAAPPWLHR

SEQ ID NO: 1388993 - protein, 9 aa, Homo Sapiens
IWDTAGQKY

SEQ ID NO: 1388994 - protein, 9 aa, Homo Sapiens
CRENIVGDA

SEQ ID NO: 1388995 - protein, 9 aa, Homo Sapiens
LVTRPPAPP

SEQ ID NO: 1388996 - protein, 9 aa, Homo Sapiens
HGFAVGIPQ

SEQ ID NO: 1388997 - protein, 9 aa, Homo Sapiens
TDAVTVLLT

SEQ ID NO: 1388998 - protein, 9 aa, Homo Sapiens
VIEAKKRIM

SEQ ID NO: 1388999 - protein, 9 aa, Homo Sapiens
LFCSLKQVH

SEQ ID NO: 1389000 - protein, 9 aa, Homo Sapiens
LSFTKQNKL

SEQ ID NO: 1389001 - protein, 9 aa, Homo Sapiens
DCLALEGVQ

SEQ ID NO: 1389002 - protein, 9 aa, Homo Sapiens
YVLFKLLWD

SEQ ID NO: 1389003 - protein, 9 aa, Homo Sapiens
THRDMLLSP

SEQ ID NO: 1389004 - protein, 9 aa, Homo Sapiens
YLNKVIKAL

SEQ ID NO: 1389005 - protein, 9 aa, Homo Sapiens
PPAKHSSSQ

SEQ ID NO: 1389006 - protein, 9 aa, Homo Sapiens
LMLGLLIEV

SEQ ID NO: 1389007 - protein, 9 aa, Homo Sapiens
LFNMNAMSV

SEQ ID NO: 1389008 - protein, 9 aa, Homo Sapiens
AQLSEDVQA

SEQ ID NO: 1389009 - protein, 9 aa, Homo Sapiens
PPRGRSQDC

SEQ ID NO: 1389010 - protein, 9 aa, Homo Sapiens
KRSHLWTLD

SEQ ID NO: 1389011 - protein, 9 aa, Homo Sapiens
VGRFPREHR

SEQ ID NO: 1389012 - protein, 9 aa, Homo Sapiens
MKKTIGCWE

SEQ ID NO: 1389013 - protein, 9 aa, Homo Sapiens
IHQSPYGVT

SEQ ID NO: 1389014 - protein, 9 aa, Homo Sapiens
LTASDDGDP

SEQ ID NO: 1389015 - protein, 9 aa, Homo Sapiens
NMETLVVVD

SEQ ID NO: 1389016 - protein, 9 aa, Homo Sapiens
IHVSVEFQG

SEQ ID NO: 1389017 - protein, 9 aa, Homo Sapiens
SYLSLKDSR

SEQ ID NO: 1389018 - protein, 9 aa, Homo Sapiens
PQAHKLWMI

SEQ ID NO: 1389019 - protein, 9 aa, Homo Sapiens
CAGIVRRGR

SEQ ID NO: 1389020 - protein, 9 aa, Homo Sapiens
VSPSARWQY

SEQ ID NO: 1389021 - protein, 9 aa, Homo Sapiens
APQTETRAP

SEQ ID NO: 1389022 - protein, 9 aa, Homo Sapiens
DDIGSEVSE

SEQ ID NO: 1389023 - protein, 9 aa, Homo Sapiens
GGFGEVCTC

SEQ ID NO: 1389024 - protein, 9 aa, Homo Sapiens
TGAYSKHTL

SEQ ID NO: 1389025 - protein, 9 aa, Homo Sapiens
NPLMKPAGH

SEQ ID NO: 1389026 - protein, 9 aa, Homo Sapiens
ASIMCPLNP

SEQ ID NO: 1389027 - protein, 9 aa, Homo Sapiens
EKNRSLILK

SEQ ID NO: 1389028 - protein, 9 aa, Homo Sapiens
NYSMVLQRL

SEQ ID NO: 1389029 - protein, 9 aa, Homo Sapiens
LASTTNKLT

SEQ ID NO: 1389030 - protein, 9 aa, Homo Sapiens
REYIHQGKE

SEQ ID NO: 1389031 - protein, 9 aa, Homo Sapiens
FLVSITSIF

SEQ ID NO: 1389032 - protein, 9 aa, Homo Sapiens
CGRHMCSMK

SEQ ID NO: 1389033 - protein, 9 aa, Homo Sapiens
PGLSQEATR

SEQ ID NO: 1389034 - protein, 9 aa, Homo Sapiens
TKKRVNTAW

SEQ ID NO: 1389035 - protein, 9 aa, Homo Sapiens
WKHMQETKK

SEQ ID NO: 1389036 - protein, 9 aa, Homo Sapiens
RHVCRHFMM

SEQ ID NO: 1389037 - protein, 9 aa, Homo Sapiens
GGGGACATC

SEQ ID NO: 1389038 - protein, 9 aa, Homo Sapiens
DGLFTSTAH

SEQ ID NO: 1389039 - protein, 9 aa, Homo Sapiens
VRKHNSNAN

SEQ ID NO: 1389040 - protein, 9 aa, Homo Sapiens
PKPLGPKSR

SEQ ID NO: 1389041 - protein, 9 aa, Homo Sapiens
KPHPGQQDG

SEQ ID NO: 1389042 - protein, 9 aa, Homo Sapiens
AQWSPVVRP

SEQ ID NO: 1389043 - protein, 9 aa, Homo Sapiens
ESIKREIQN

SEQ ID NO: 1389044 - protein, 9 aa, Homo Sapiens
STVSETQWK

SEQ ID NO: 1389045 - protein, 9 aa, Homo Sapiens
TRTCSWQVL

SEQ ID NO: 1389046 - protein, 9 aa, Homo Sapiens
PQPSLPGPC

SEQ ID NO: 1389047 - protein, 9 aa, Homo Sapiens
KQIKTKPTD

SEQ ID NO: 1389048 - protein, 9 aa, Homo Sapiens
PLTCRCTTP

SEQ ID NO: 1389049 - protein, 9 aa, Homo Sapiens
EADGLDSGA

SEQ ID NO: 1389050 - protein, 9 aa, Homo Sapiens
TNHCDGVFD

SEQ ID NO: 1389051 - protein, 9 aa, Homo Sapiens
EGCDWRFAN

SEQ ID NO: 1389052 - protein, 9 aa, Homo Sapiens
LLEVNLSFF

SEQ ID NO: 1389053 - protein, 9 aa, Homo Sapiens
GSVGAGTWT

SEQ ID NO: 1389054 - protein, 9 aa, Homo Sapiens
FSHAPPVAE

SEQ ID NO: 1389055 - protein, 9 aa, Homo Sapiens
NLSQVGVKI

SEQ ID NO: 1389056 - protein, 9 aa, Homo Sapiens
STLVLDVSS

SEQ ID NO: 1389057 - protein, 9 aa, Homo Sapiens
ELELKHWCP

SEQ ID NO: 1389058 - protein, 9 aa, Homo Sapiens
MVLQRLLHP

SEQ ID NO: 1389059 - protein, 9 aa, Homo Sapiens
DERQIKIWF

SEQ ID NO: 1389060 - protein, 9 aa, Homo Sapiens
SPIPITVTR

SEQ ID NO: 1389061 - protein, 9 aa, Homo Sapiens
LKHFRVLQH

SEQ ID NO: 1389062 - protein, 9 aa, Homo Sapiens
LLIQPCIQI

SEQ ID NO: 1389063 - protein, 9 aa, Homo Sapiens
PPWSPSTQT

SEQ ID NO: 1389064 - protein, 9 aa, Homo Sapiens
SVKTRSEWQ

SEQ ID NO: 1389065 - protein, 9 aa, Homo Sapiens
PSMHILSSC

SEQ ID NO: 1389066 - protein, 9 aa, Homo Sapiens
RGGGGGQGA

SEQ ID NO: 1389067 - protein, 9 aa, Homo Sapiens
FKVLLMLGL

SEQ ID NO: 1389068 - protein, 9 aa, Homo Sapiens
FHIDFEDPA

SEQ ID NO: 1389069 - protein, 9 aa, Homo Sapiens
RAPTKQPPR

SEQ ID NO: 1389070 - protein, 9 aa, Homo Sapiens
HTNKEAICK

SEQ ID NO: 1389071 - protein, 9 aa, Homo Sapiens
QRGEEEAAE

SEQ ID NO: 1389072 - protein, 9 aa, Homo Sapiens
GVNAKKMVT

SEQ ID NO: 1389073 - protein, 9 aa, Homo Sapiens
ITLKRIFIP

SEQ ID NO: 1389074 - protein, 9 aa, Homo Sapiens
ILIAYNGIP

SEQ ID NO: 1389075 - protein, 9 aa, Homo Sapiens
YLETHCTVA

SEQ ID NO: 1389076 - protein, 9 aa, Homo Sapiens
KICVRSAVE

SEQ ID NO: 1389077 - protein, 9 aa, Homo Sapiens
PKGPKGGLQ

SEQ ID NO: 1389078 - protein, 9 aa, Homo Sapiens
MSFEDFLLV

SEQ ID NO: 1389079 - protein, 9 aa, Homo Sapiens
VKSSTCPGE

SEQ ID NO: 1389080 - protein, 9 aa, Homo Sapiens
THHVVPAQV

SEQ ID NO: 1389081 - protein, 9 aa, Homo Sapiens
DSLTCFNQT

SEQ ID NO: 1389082 - protein, 9 aa, Homo Sapiens
FEGILYKRG

SEQ ID NO: 1389083 - protein, 9 aa, Homo Sapiens
FYISILIAY

SEQ ID NO: 1389084 - protein, 9 aa, Homo Sapiens
APGRGSLHK

SEQ ID NO: 1389085 - protein, 9 aa, Homo Sapiens
ASLSTLGDV

SEQ ID NO: 1389086 - protein, 9 aa, Homo Sapiens
ANLEKIYRE

SEQ ID NO: 1389087 - protein, 9 aa, Homo Sapiens
TATPDQDCD

SEQ ID NO: 1389088 - protein, 9 aa, Homo Sapiens
LSEKKFLKI

SEQ ID NO: 1389089 - protein, 9 aa, Homo Sapiens
AVELKSEEY

SEQ ID NO: 1389090 - protein, 9 aa, Homo Sapiens
ETSLPLDMY

SEQ ID NO: 1389091 - protein, 9 aa, Homo Sapiens
ISKVKLRMS

SEQ ID NO: 1389092 - protein, 9 aa, Homo Sapiens
LPRMPGPPW

SEQ ID NO: 1389093 - protein, 9 aa, Homo Sapiens
AVCVMLDLA

SEQ ID NO: 1389094 - protein, 9 aa, Homo Sapiens
LVALSWRGL

SEQ ID NO: 1389095 - protein, 9 aa, Homo Sapiens
VSNMDGWLR

SEQ ID NO: 1389096 - protein, 9 aa, Homo Sapiens
LAAEFQHLQ

SEQ ID NO: 1389097 - protein, 9 aa, Homo Sapiens
PSSMTLTVT

SEQ ID NO: 1389098 - protein, 9 aa, Homo Sapiens
WLAVSYAGS

SEQ ID NO: 1389099 - protein, 9 aa, Homo Sapiens
EASIHTSCC

SEQ ID NO: 1389100 - protein, 9 aa, Homo Sapiens
EFSPIPITV

SEQ ID NO: 1389101 - protein, 9 aa, Homo Sapiens
STAHVHIRV

SEQ ID NO: 1389102 - protein, 9 aa, Homo Sapiens
EAIKGLLGL

SEQ ID NO: 1389103 - protein, 9 aa, Homo Sapiens
GDDDVFEDN

SEQ ID NO: 1389104 - protein, 9 aa, Homo Sapiens
QLVVRLGLQ

SEQ ID NO: 1389105 - protein, 9 aa, Homo Sapiens
YLMGVSVCP

SEQ ID NO: 1389106 - protein, 9 aa, Homo Sapiens
SGGRTAAVG

SEQ ID NO: 1389107 - protein, 9 aa, Homo Sapiens
GFMKKSHIK

SEQ ID NO: 1389108 - protein, 9 aa, Homo Sapiens
LCLLAPPQC

SEQ ID NO: 1389109 - protein, 9 aa, Homo Sapiens
RAPAVLDSI

SEQ ID NO: 1389110 - protein, 9 aa, Homo Sapiens
RKWKLTSST

SEQ ID NO: 1389111 - protein, 9 aa, Homo Sapiens
TGEQTHWLR

SEQ ID NO: 1389112 - protein, 9 aa, Homo Sapiens
GIVLKVVSI

SEQ ID NO: 1389113 - protein, 9 aa, Homo Sapiens
ATGAMKVQS

SEQ ID NO: 1389114 - protein, 9 aa, Homo Sapiens
KTQIFICFI

SEQ ID NO: 1389115 - protein, 9 aa, Homo Sapiens
RQLLCLINY

SEQ ID NO: 1389116 - protein, 9 aa, Homo Sapiens
PHLPVTAFI

SEQ ID NO: 1389117 - protein, 9 aa, Homo Sapiens
NPAKCITAH

SEQ ID NO: 1389118 - protein, 9 aa, Homo Sapiens
GLVAYEDGK

SEQ ID NO: 1389119 - protein, 9 aa, Homo Sapiens
YICVASLKG

SEQ ID NO: 1389120 - protein, 9 aa, Homo Sapiens
GFPPRVECL

SEQ ID NO: 1389121 - protein, 9 aa, Homo Sapiens
PVRKHNSNA

SEQ ID NO: 1389122 - protein, 9 aa, Homo Sapiens
SHHPAPESL

SEQ ID NO: 1389123 - protein, 9 aa, Homo Sapiens
DSISHSRRR

SEQ ID NO: 1389124 - protein, 9 aa, Homo Sapiens
TGSHASTHD

SEQ ID NO: 1389125 - protein, 9 aa, Homo Sapiens
AVTLYGGRS

SEQ ID NO: 1389126 - protein, 9 aa, Homo Sapiens
LAWVSFSLC

SEQ ID NO: 1389127 - protein, 9 aa, Homo Sapiens
QAFMNSGFG

SEQ ID NO: 1389128 - protein, 9 aa, Homo Sapiens
CSTSLGWCL

SEQ ID NO: 1389129 - protein, 9 aa, Homo Sapiens
QHGIQRVEA

SEQ ID NO: 1389130 - protein, 9 aa, Homo Sapiens
FNTPPTCPR

SEQ ID NO: 1389131 - protein, 9 aa, Homo Sapiens
HLNLDDRHW

SEQ ID NO: 1389132 - protein, 9 aa, Homo Sapiens
LHEHSNPNY

SEQ ID NO: 1389133 - protein, 9 aa, Homo Sapiens
KLLKNILPK

SEQ ID NO: 1389134 - protein, 9 aa, Homo Sapiens
VFGKSDELI

SEQ ID NO: 1389135 - protein, 9 aa, Homo Sapiens
DMLVNQPLA

SEQ ID NO: 1389136 - protein, 9 aa, Homo Sapiens
VSPSEEELP

SEQ ID NO: 1389137 - protein, 9 aa, Homo Sapiens
NSNGLEQIC

SEQ ID NO: 1389138 - protein, 9 aa, Homo Sapiens
GAQPASSTR

SEQ ID NO: 1389139 - protein, 9 aa, Homo Sapiens
ILTPIEAYS

SEQ ID NO: 1389140 - protein, 9 aa, Homo Sapiens
IPVRPMGAR

SEQ ID NO: 1389141 - protein, 9 aa, Homo Sapiens
QTQFLRSVF

SEQ ID NO: 1389142 - protein, 9 aa, Homo Sapiens
RSGTLGLVV

SEQ ID NO: 1389143 - protein, 9 aa, Homo Sapiens
KSQGGRILL

SEQ ID NO: 1389144 - protein, 9 aa, Homo Sapiens
SVSSTGRPA

SEQ ID NO: 1389145 - protein, 9 aa, Homo Sapiens
LLVNMGGNR

SEQ ID NO: 1389146 - protein, 9 aa, Homo Sapiens
WHPSCLTPS

SEQ ID NO: 1389147 - protein, 9 aa, Homo Sapiens
NILILEKIE

SEQ ID NO: 1389148 - protein, 9 aa, Homo Sapiens
ILTGVYALI

SEQ ID NO: 1389149 - protein, 9 aa, Homo Sapiens
PLHSPHKGP

SEQ ID NO: 1389150 - protein, 9 aa, Homo Sapiens
KSFISSQSF

SEQ ID NO: 1389151 - protein, 9 aa, Homo Sapiens
GPPWPTHLP

SEQ ID NO: 1389152 - protein, 9 aa, Homo Sapiens
HCQMSGTSG

SEQ ID NO: 1389153 - protein, 9 aa, Homo Sapiens
RKGQKFGLD

SEQ ID NO: 1389154 - protein, 9 aa, Homo Sapiens
VPQSPPMDL

SEQ ID NO: 1389155 - protein, 9 aa, Homo Sapiens
RLTIRKEED

SEQ ID NO: 1389156 - protein, 9 aa, Homo Sapiens
SKHTLSALP

SEQ ID NO: 1389157 - protein, 9 aa, Homo Sapiens
SGTETSSSE

SEQ ID NO: 1389158 - protein, 9 aa, Homo Sapiens
SPPMDLPGL

SEQ ID NO: 1389159 - protein, 9 aa, Homo Sapiens
SSPKLFSST

SEQ ID NO: 1389160 - protein, 9 aa, Homo Sapiens
TQRTSAGCS

SEQ ID NO: 1389161 - protein, 9 aa, Homo Sapiens
DLLGQPMIL

SEQ ID NO: 1389162 - protein, 9 aa, Homo Sapiens
MKYEHQKKL

SEQ ID NO: 1389163 - protein, 9 aa, Homo Sapiens
CVNCVQGVA

SEQ ID NO: 1389164 - protein, 9 aa, Homo Sapiens
CPLNPAAQD

SEQ ID NO: 1389165 - protein, 9 aa, Homo Sapiens
VSETQWKVT

SEQ ID NO: 1389166 - protein, 9 aa, Homo Sapiens
TPTQYIAVR

SEQ ID NO: 1389167 - protein, 9 aa, Homo Sapiens
SILIAYNGI

SEQ ID NO: 1389168 - protein, 9 aa, Homo Sapiens
SENAPVGTS

SEQ ID NO: 1389169 - protein, 9 aa, Homo Sapiens
SGIDLTKKD

SEQ ID NO: 1389170 - protein, 9 aa, Homo Sapiens
IPGIRGALT

SEQ ID NO: 1389171 - protein, 9 aa, Homo Sapiens
LWKELSHLP

SEQ ID NO: 1389172 - protein, 9 aa, Homo Sapiens
PGSGPHLPV

SEQ ID NO: 1389173 - protein, 9 aa, Homo Sapiens
GWGAWLAVS

SEQ ID NO: 1389174 - protein, 9 aa, Homo Sapiens
LCSARALPR

SEQ ID NO: 1389175 - protein, 9 aa, Homo Sapiens
RKEKNSRED

SEQ ID NO: 1389176 - protein, 9 aa, Homo Sapiens
KRKRKCQKR

SEQ ID NO: 1389177 - protein, 9 aa, Homo Sapiens
KRKCQKRAP

SEQ ID NO: 1389178 - protein, 9 aa, Homo Sapiens
QKRTQTCTN

SEQ ID NO: 1389179 - protein, 9 aa, Homo Sapiens
GAVREQHGI

SEQ ID NO: 1389180 - protein, 9 aa, Homo Sapiens
LLPLLESST

SEQ ID NO: 1389181 - protein, 9 aa, Homo Sapiens
CVIRTPQGN

SEQ ID NO: 1389182 - protein, 9 aa, Homo Sapiens
NCFYLHISQ

SEQ ID NO: 1389183 - protein, 9 aa, Homo Sapiens
TVSFVGQIS

SEQ ID NO: 1389184 - protein, 9 aa, Homo Sapiens
GEVVKAFVT

SEQ ID NO: 1389185 - protein, 9 aa, Homo Sapiens
GDFLVCGNR

SEQ ID NO: 1389186 - protein, 9 aa, Homo Sapiens
LRMSFLLNN

SEQ ID NO: 1389187 - protein, 9 aa, Homo Sapiens
RKEDMEIMS

SEQ ID NO: 1389188 - protein, 9 aa, Homo Sapiens
VPVEYAEEE

SEQ ID NO: 1389189 - protein, 9 aa, Homo Sapiens
SQNWGSLPL

SEQ ID NO: 1389190 - protein, 9 aa, Homo Sapiens
GSFSSNLIQ

SEQ ID NO: 1389191 - protein, 9 aa, Homo Sapiens
ASLGGLRAN

SEQ ID NO: 1389192 - protein, 9 aa, Homo Sapiens
RLLTRQDVQ

SEQ ID NO: 1389193 - protein, 9 aa, Homo Sapiens
PVMVYQTKS

SEQ ID NO: 1389194 - protein, 9 aa, Homo Sapiens
LPHHMRTHT

SEQ ID NO: 1389195 - protein, 9 aa, Homo Sapiens
NRSKVESSY

SEQ ID NO: 1389196 - protein, 9 aa, Homo Sapiens
QGGRILLQR

SEQ ID NO: 1389197 - protein, 9 aa, Homo Sapiens
PLCVKKLYV

SEQ ID NO: 1389198 - protein, 9 aa, Homo Sapiens
EQKKGKRKD

SEQ ID NO: 1389199 - protein, 9 aa, Homo Sapiens
ISELHLATA

SEQ ID NO: 1389200 - protein, 9 aa, Homo Sapiens
VIAVPTSDL

SEQ ID NO: 1389201 - protein, 9 aa, Homo Sapiens
FYSNSTVSE

SEQ ID NO: 1389202 - protein, 9 aa, Homo Sapiens
HTGRSGSRI

SEQ ID NO: 1389203 - protein, 9 aa, Homo Sapiens
VLALEVTFP

SEQ ID NO: 1389204 - protein, 9 aa, Homo Sapiens
KVESSYRSS

SEQ ID NO: 1389205 - protein, 9 aa, Homo Sapiens
PPGTAMPQM

SEQ ID NO: 1389206 - protein, 9 aa, Homo Sapiens
TQRGEEEAA

SEQ ID NO: 1389207 - protein, 9 aa, Homo Sapiens
AKREEECSP

SEQ ID NO: 1389208 - protein, 9 aa, Homo Sapiens
IRTLLPLLE

SEQ ID NO: 1389209 - protein, 9 aa, Homo Sapiens
EGGADGSIT

SEQ ID NO: 1389210 - protein, 9 aa, Homo Sapiens
SKYSGTHHV

SEQ ID NO: 1389211 - protein, 9 aa, Homo Sapiens
FRDLLKVGT

SEQ ID NO: 1389212 - protein, 9 aa, Homo Sapiens
ESKQTAPKM

SEQ ID NO: 1389213 - protein, 9 aa, Homo Sapiens
SSWYIQGCD

SEQ ID NO: 1389214 - protein, 9 aa, Homo Sapiens
APVPMGSIS

SEQ ID NO: 1389215 - protein, 9 aa, Homo Sapiens
EGSKRSSRS

SEQ ID NO: 1389216 - protein, 9 aa, Homo Sapiens
AGSQVHSPC

SEQ ID NO: 1389217 - protein, 9 aa, Homo Sapiens
FQKVLNWSL

SEQ ID NO: 1389218 - protein, 9 aa, Homo Sapiens
EKYFLLQTT

SEQ ID NO: 1389219 - protein, 9 aa, Homo Sapiens
KRFAACWSP

SEQ ID NO: 1389220 - protein, 9 aa, Homo Sapiens
ELKKTYEDP

SEQ ID NO: 1389221 - protein, 9 aa, Homo Sapiens
KKRRNLQRN

SEQ ID NO: 1389222 - protein, 9 aa, Homo Sapiens
FRIQHMDLS

SEQ ID NO: 1389223 - protein, 9 aa, Homo Sapiens
RQAEIQKEC

SEQ ID NO: 1389224 - protein, 9 aa, Homo Sapiens
SRDSRSFFT

SEQ ID NO: 1389225 - protein, 9 aa, Homo Sapiens
PPHTPSHHP

SEQ ID NO: 1389226 - protein, 9 aa, Homo Sapiens
KSSTCPGEQ

SEQ ID NO: 1389227 - protein, 9 aa, Homo Sapiens
EKMSRISGF

SEQ ID NO: 1389228 - protein, 9 aa, Homo Sapiens
GCAERVGNM

SEQ ID NO: 1389229 - protein, 9 aa, Homo Sapiens
LVLTVLDEE

SEQ ID NO: 1389230 - protein, 9 aa, Homo Sapiens
SSSDSSSNS

SEQ ID NO: 1389231 - protein, 9 aa, Homo Sapiens
SSLCSTSLG

SEQ ID NO: 1389232 - protein, 9 aa, Homo Sapiens
SLRTISSSV

SEQ ID NO: 1389233 - protein, 9 aa, Homo Sapiens
RTQTCTNPA

SEQ ID NO: 1389234 - protein, 9 aa, Homo Sapiens
DAWFPDQGR

SEQ ID NO: 1389235 - protein, 9 aa, Homo Sapiens
NAAAGSQDV

SEQ ID NO: 1389236 - protein, 9 aa, Homo Sapiens
STLTTHKNS

SEQ ID NO: 1389237 - protein, 9 aa, Homo Sapiens
VKLLDYTKK

SEQ ID NO: 1389238 - protein, 9 aa, Homo Sapiens
PQNVRRILI

SEQ ID NO: 1389239 - protein, 9 aa, Homo Sapiens
LPGKELNSV

SEQ ID NO: 1389240 - protein, 9 aa, Homo Sapiens
RGAGVSPLC

SEQ ID NO: 1389241 - protein, 9 aa, Homo Sapiens
GCSMQMRRR

SEQ ID NO: 1389242 - protein, 9 aa, Homo Sapiens
TLLILTTLS

SEQ ID NO: 1389243 - protein, 9 aa, Homo Sapiens
HPSRPCRMR

SEQ ID NO: 1389244 - protein, 9 aa, Homo Sapiens
LNVALTSLH

SEQ ID NO: 1389245 - protein, 9 aa, Homo Sapiens
ILILEKIEH

SEQ ID NO: 1389246 - protein, 9 aa, Homo Sapiens
LDSISHSRR

SEQ ID NO: 1389247 - protein, 9 aa, Homo Sapiens
AKKVYVTSQ

SEQ ID NO: 1389248 - protein, 9 aa, Homo Sapiens
ASHFCQFHY

SEQ ID NO: 1389249 - protein, 9 aa, Homo Sapiens
LHAVHHCSS

SEQ ID NO: 1389250 - protein, 9 aa, Homo Sapiens
GSLGRCGCS

SEQ ID NO: 1389251 - protein, 9 aa, Homo Sapiens
FIGDRNICR

SEQ ID NO: 1389252 - protein, 9 aa, Homo Sapiens
ERLTNSLMD

SEQ ID NO: 1389253 - protein, 9 aa, Homo Sapiens
DQQGQGSHY

SEQ ID NO: 1389254 - protein, 9 aa, Homo Sapiens
PVEYAEEEK

SEQ ID NO: 1389255 - protein, 9 aa, Homo Sapiens
LGAAQLLGM

SEQ ID NO: 1389256 - protein, 9 aa, Homo Sapiens
WTNLQAALD

SEQ ID NO: 1389257 - protein, 9 aa, Homo Sapiens
HYVLYMSNH

SEQ ID NO: 1389258 - protein, 9 aa, Homo Sapiens
KMPLMIFAN

SEQ ID NO: 1389259 - protein, 9 aa, Homo Sapiens
KALLDKKNR

SEQ ID NO: 1389260 - protein, 9 aa, Homo Sapiens
EEYRLLLKH

SEQ ID NO: 1389261 - protein, 9 aa, Homo Sapiens
RYSMAHSAT

SEQ ID NO: 1389262 - protein, 9 aa, Homo Sapiens
GRFPREHRI

SEQ ID NO: 1389263 - protein, 9 aa, Homo Sapiens
RVFGIRWDT

SEQ ID NO: 1389264 - protein, 9 aa, Homo Sapiens
QRRRRYRSC

SEQ ID NO: 1389265 - protein, 9 aa, Homo Sapiens
FAVTLYGGR

SEQ ID NO: 1389266 - protein, 9 aa, Homo Sapiens
RENNSPPCT

SEQ ID NO: 1389267 - protein, 9 aa, Homo Sapiens
GVHGTSHQP

SEQ ID NO: 1389268 - protein, 9 aa, Homo Sapiens
LLSFRDGKT

SEQ ID NO: 1389269 - protein, 9 aa, Homo Sapiens
HELVLTFNN

SEQ ID NO: 1389270 - protein, 9 aa, Homo Sapiens
SKMYHCDMY

SEQ ID NO: 1389271 - protein, 9 aa, Homo Sapiens
SKRPWSQKT

SEQ ID NO: 1389272 - protein, 9 aa, Homo Sapiens
EAICKAGGI

SEQ ID NO: 1389273 - protein, 9 aa, Homo Sapiens
IEVSISENA

SEQ ID NO: 1389274 - protein, 9 aa, Homo Sapiens
EALHEHSNP

SEQ ID NO: 1389275 - protein, 9 aa, Homo Sapiens
SLDGITNLP

SEQ ID NO: 1389276 - protein, 9 aa, Homo Sapiens
SFPWGTLSI

SEQ ID NO: 1389277 - protein, 9 aa, Homo Sapiens
AACWSPWAS

SEQ ID NO: 1389278 - protein, 9 aa, Homo Sapiens
GQFRAGPTP

SEQ ID NO: 1389279 - protein, 9 aa, Homo Sapiens
IRDTIPNIN

SEQ ID NO: 1389280 - protein, 9 aa, Homo Sapiens
EARHALSWS

SEQ ID NO: 1389281 - protein, 9 aa, Homo Sapiens
VTRYQSKAS

SEQ ID NO: 1389282 - protein, 9 aa, Homo Sapiens
HFHVTVFKF

SEQ ID NO: 1389283 - protein, 9 aa, Homo Sapiens
PKSTWDLPR

SEQ ID NO: 1389284 - protein, 9 aa, Homo Sapiens
HLCLLAPPQ

SEQ ID NO: 1389285 - protein, 9 aa, Homo Sapiens
KNSSRADGL

SEQ ID NO: 1389286 - protein, 9 aa, Homo Sapiens
GSRVCLANG

SEQ ID NO: 1389287 - protein, 9 aa, Homo Sapiens
YEHVMKLRR

SEQ ID NO: 1389288 - protein, 9 aa, Homo Sapiens
HPPSSPPPR

SEQ ID NO: 1389289 - protein, 9 aa, Homo Sapiens
NVFLGGVPW

SEQ ID NO: 1389290 - protein, 9 aa, Homo Sapiens
GRHHHHPLP

SEQ ID NO: 1389291 - protein, 9 aa, Homo Sapiens
KCDMSVLQR

SEQ ID NO: 1389292 - protein, 9 aa, Homo Sapiens
KFLVSITSI

SEQ ID NO: 1389293 - protein, 9 aa, Homo Sapiens
LAGFGHGLH

SEQ ID NO: 1389294 - protein, 9 aa, Homo Sapiens
HVLPQAQLQ

SEQ ID NO: 1389295 - protein, 9 aa, Homo Sapiens
SRLQKVPKI

SEQ ID NO: 1389296 - protein, 9 aa, Homo Sapiens
EGSEEEGKR

SEQ ID NO: 1389297 - protein, 9 aa, Homo Sapiens
ADYFKNVAR

SEQ ID NO: 1389298 - protein, 9 aa, Homo Sapiens
RFGGRGTTD

SEQ ID NO: 1389299 - protein, 9 aa, Homo Sapiens
FMKKSHIKW

SEQ ID NO: 1389300 - protein, 9 aa, Homo Sapiens
NSLLHVYRL

SEQ ID NO: 1389301 - protein, 9 aa, Homo Sapiens
ASTHDNLPE

SEQ ID NO: 1389302 - protein, 9 aa, Homo Sapiens
HARTTASAL

SEQ ID NO: 1389303 - protein, 9 aa, Homo Sapiens
PWSQKTEKV

SEQ ID NO: 1389304 - protein, 9 aa, Homo Sapiens
SPSWAWRSR

SEQ ID NO: 1389305 - protein, 9 aa, Homo Sapiens
DKHLVDELL

SEQ ID NO: 1389306 - protein, 9 aa, Homo Sapiens
DWRFANSSD

SEQ ID NO: 1389307 - protein, 9 aa, Homo Sapiens
VLVVGRFPR

SEQ ID NO: 1389308 - protein, 9 aa, Homo Sapiens
ASKKCRVNA

SEQ ID NO: 1389309 - protein, 9 aa, Homo Sapiens
DVVAQMDED

SEQ ID NO: 1389310 - protein, 9 aa, Homo Sapiens
SHRNEELNM

SEQ ID NO: 1389311 - protein, 9 aa, Homo Sapiens
LPGIAHLPL

SEQ ID NO: 1389312 - protein, 9 aa, Homo Sapiens
SPPPRPPWA

SEQ ID NO: 1389313 - protein, 9 aa, Homo Sapiens
TDIPIHDTI

SEQ ID NO: 1389314 - protein, 9 aa, Homo Sapiens
TPEQFPFTS

SEQ ID NO: 1389315 - protein, 9 aa, Homo Sapiens
ILLIVRLAV

SEQ ID NO: 1389316 - protein, 9 aa, Homo Sapiens
EGPPACRLH

SEQ ID NO: 1389317 - protein, 9 aa, Homo Sapiens
GIIGGFWLS

SEQ ID NO: 1389318 - protein, 9 aa, Homo Sapiens
FPAVAFRLA

SEQ ID NO: 1389319 - protein, 9 aa, Homo Sapiens
LFSMFFSQS

SEQ ID NO: 1389320 - protein, 9 aa, Homo Sapiens
TRNNLGFTP

SEQ ID NO: 1389321 - protein, 9 aa, Homo Sapiens
RLLHPPSSP

SEQ ID NO: 1389322 - protein, 9 aa, Homo Sapiens
ESVHCKGRI

SEQ ID NO: 1389323 - protein, 9 aa, Homo Sapiens
CRRDDSSES

SEQ ID NO: 1389324 - protein, 9 aa, Homo Sapiens
RMDSIKPDL

SEQ ID NO: 1389325 - protein, 9 aa, Homo Sapiens
KLNNKYLRQ

SEQ ID NO: 1389326 - protein, 9 aa, Homo Sapiens
DHNPLTTVE

SEQ ID NO: 1389327 - protein, 9 aa, Homo Sapiens
PHQRRSAHK

SEQ ID NO: 1389328 - protein, 9 aa, Homo Sapiens
KLRMSFLLN

SEQ ID NO: 1389329 - protein, 9 aa, Homo Sapiens
RGEKGDRSK

SEQ ID NO: 1389330 - protein, 9 aa, Homo Sapiens
QRKKLSDTP

SEQ ID NO: 1389331 - protein, 9 aa, Homo Sapiens
GFMSSTSFL

SEQ ID NO: 1389332 - protein, 9 aa, Homo Sapiens
EYIHQGKEA

SEQ ID NO: 1389333 - protein, 9 aa, Homo Sapiens
PPVTANITA

SEQ ID NO: 1389334 - protein, 9 aa, Homo Sapiens
EAPSTRAAP

SEQ ID NO: 1389335 - protein, 9 aa, Homo Sapiens
GLSVAFSPS

SEQ ID NO: 1389336 - protein, 9 aa, Homo Sapiens
GIELHSDVE

SEQ ID NO: 1389337 - protein, 9 aa, Homo Sapiens
RVGKGNVTR

SEQ ID NO: 1389338 - protein, 9 aa, Homo Sapiens
SEGVIAVPT

SEQ ID NO: 1389339 - protein, 9 aa, Homo Sapiens
SNQSLLSIL

SEQ ID NO: 1389340 - protein, 9 aa, Homo Sapiens
RRISSSVLV

SEQ ID NO: 1389341 - protein, 9 aa, Homo Sapiens
LSAGYLCCA

SEQ ID NO: 1389342 - protein, 9 aa, Homo Sapiens
EPLSFLQCL

SEQ ID NO: 1389343 - protein, 9 aa, Homo Sapiens
GVNIAVIIY

SEQ ID NO: 1389344 - protein, 9 aa, Homo Sapiens
KPQWLRATW

SEQ ID NO: 1389345 - protein, 9 aa, Homo Sapiens
AACAPGRVA

SEQ ID NO: 1389346 - protein, 9 aa, Homo Sapiens
RSHVQVGGI

SEQ ID NO: 1389347 - protein, 9 aa, Homo Sapiens
YWTNLQAAL

SEQ ID NO: 1389348 - protein, 9 aa, Homo Sapiens
HLVPGDLPW

SEQ ID NO: 1389349 - protein, 9 aa, Homo Sapiens
PTLGCSMQM

SEQ ID NO: 1389350 - protein, 9 aa, Homo Sapiens
PASSTRPAA

SEQ ID NO: 1389351 - protein, 9 aa, Homo Sapiens
DGDEVEEEE

SEQ ID NO: 1389352 - protein, 9 aa, Homo Sapiens
GATECLLLV

SEQ ID NO: 1389353 - protein, 9 aa, Homo Sapiens
FLNSNGLEQ

SEQ ID NO: 1389354 - protein, 9 aa, Homo Sapiens
LKWELELKH

SEQ ID NO: 1389355 - protein, 9 aa, Homo Sapiens
LRMRYVLFH

SEQ ID NO: 1389356 - protein, 9 aa, Homo Sapiens
TSSTGSSRE

SEQ ID NO: 1389357 - protein, 9 aa, Homo Sapiens
YLDQWTPTK

SEQ ID NO: 1389358 - protein, 9 aa, Homo Sapiens
LMIISLPTK

SEQ ID NO: 1389359 - protein, 9 aa, Homo Sapiens
ILYKRGALL

SEQ ID NO: 1389360 - protein, 9 aa, Homo Sapiens
LPPIFGDLL

SEQ ID NO: 1389361 - protein, 9 aa, Homo Sapiens
IHTSCCHAP

SEQ ID NO: 1389362 - protein, 9 aa, Homo Sapiens
TSPKVTLGW

SEQ ID NO: 1389363 - protein, 9 aa, Homo Sapiens
GHLFRHLLG

SEQ ID NO: 1389364 - protein, 9 aa, Homo Sapiens
CPPWTLRMQ

SEQ ID NO: 1389365 - protein, 9 aa, Homo Sapiens
GRRQSRHSR

SEQ ID NO: 1389366 - protein, 9 aa, Homo Sapiens
LGRLPPGAP

SEQ ID NO: 1389367 - protein, 9 aa, Homo Sapiens
HMVSEGGPE

SEQ ID NO: 1389368 - protein, 9 aa, Homo Sapiens
GASSSTSRD

SEQ ID NO: 1389369 - protein, 9 aa, Homo Sapiens
MTGKIILVF

SEQ ID NO: 1389370 - protein, 9 aa, Homo Sapiens
GAGEEGPGL

SEQ ID NO: 1389371 - protein, 9 aa, Homo Sapiens
RSKRGEKGE

SEQ ID NO: 1389372 - protein, 9 aa, Homo Sapiens
SSTCPGEQL

SEQ ID NO: 1389373 - protein, 9 aa, Homo Sapiens
TEEYQLFKE

SEQ ID NO: 1389374 - protein, 9 aa, Homo Sapiens
EPTLPFEVV

SEQ ID NO: 1389375 - protein, 9 aa, Homo Sapiens
GEPWRAGFQ

SEQ ID NO: 1389376 - protein, 9 aa, Homo Sapiens
EDALVTRYQ

SEQ ID NO: 1389377 - protein, 9 aa, Homo Sapiens
SHFCQFHYS

SEQ ID NO: 1389378 - protein, 9 aa, Homo Sapiens
VCVPRRPWK

SEQ ID NO: 1389379 - protein, 9 aa, Homo Sapiens
GPPSRGPPG

SEQ ID NO: 1389380 - protein, 9 aa, Homo Sapiens
SILQHAADL

SEQ ID NO: 1389381 - protein, 9 aa, Homo Sapiens
VFMNQQFRN

SEQ ID NO: 1389382 - protein, 9 aa, Homo Sapiens
LCLEEPPRL

SEQ ID NO: 1389383 - protein, 9 aa, Homo Sapiens
QTHWLRPTS

SEQ ID NO: 1389384 - protein, 9 aa, Homo Sapiens
TQESTAKKI

SEQ ID NO: 1389385 - protein, 9 aa, Homo Sapiens
EKKSTKPQK

SEQ ID NO: 1389386 - protein, 9 aa, Homo Sapiens
EIQLCLLCP

SEQ ID NO: 1389387 - protein, 9 aa, Homo Sapiens
AKPISDNSS

SEQ ID NO: 1389388 - protein, 9 aa, Homo Sapiens
STDKNGFKA

SEQ ID NO: 1389389 - protein, 9 aa, Homo Sapiens
SLWLSWRWG

SEQ ID NO: 1389390 - protein, 9 aa, Homo Sapiens
AVLECLTAE

SEQ ID NO: 1389391 - protein, 9 aa, Homo Sapiens
CVRLLGIFK

SEQ ID NO: 1389392 - protein, 9 aa, Homo Sapiens
KKRPQRKGV

SEQ ID NO: 1389393 - protein, 9 aa, Homo Sapiens
LILDHNPLT

SEQ ID NO: 1389394 - protein, 9 aa, Homo Sapiens
IISLPTKMV

SEQ ID NO: 1389395 - protein, 9 aa, Homo Sapiens
ITATRTSPA

SEQ ID NO: 1389396 - protein, 9 aa, Homo Sapiens
RKKKKRPFL

SEQ ID NO: 1389397 - protein, 9 aa, Homo Sapiens
IGPPGRPGL

SEQ ID NO: 1389398 - protein, 9 aa, Homo Sapiens
SRGPAAWKK

SEQ ID NO: 1389399 - protein, 9 aa, Homo Sapiens
APPWLHRLW

SEQ ID NO: 1389400 - protein, 9 aa, Homo Sapiens
LLGLPGPKG

SEQ ID NO: 1389401 - protein, 9 aa, Homo Sapiens
SPPSQPPSP

SEQ ID NO: 1389402 - protein, 9 aa, Homo Sapiens
QFHYSMDLF

SEQ ID NO: 1389403 - protein, 9 aa, Homo Sapiens
ILGWGVGGV

SEQ ID NO: 1389404 - protein, 9 aa, Homo Sapiens
RSINHANLI

SEQ ID NO: 1389405 - protein, 9 aa, Homo Sapiens
GRRDPQDGC

SEQ ID NO: 1389406 - protein, 9 aa, Homo Sapiens
PPGAPFLRG

SEQ ID NO: 1389407 - protein, 9 aa, Homo Sapiens
TTSHLEGTA

SEQ ID NO: 1389408 - protein, 9 aa, Homo Sapiens
SSNLIQAVT

SEQ ID NO: 1389409 - protein, 9 aa, Homo Sapiens
SSELDVFII

SEQ ID NO: 1389410 - protein, 9 aa, Homo Sapiens
MSQRVCLWL

SEQ ID NO: 1389411 - protein, 9 aa, Homo Sapiens
SKPLCVKKL

SEQ ID NO: 1389412 - protein, 9 aa, Homo Sapiens
SWTLWLFWM

SEQ ID NO: 1389413 - protein, 9 aa, Homo Sapiens
CFKLMVLLK

SEQ ID NO: 1389414 - protein, 9 aa, Homo Sapiens
DCIHDIRRS

SEQ ID NO: 1389415 - protein, 9 aa, Homo Sapiens
NLHALSKLK

SEQ ID NO: 1389416 - protein, 9 aa, Homo Sapiens
DMLHHFHTH

SEQ ID NO: 1389417 - protein, 9 aa, Homo Sapiens
QRQDNCQPT

SEQ ID NO: 1389418 - protein, 9 aa, Homo Sapiens
TLLFEVFTI

SEQ ID NO: 1389419 - protein, 9 aa, Homo Sapiens
RGCNWTPES

SEQ ID NO: 1389420 - protein, 9 aa, Homo Sapiens
MPGPPWPTH

SEQ ID NO: 1389421 - protein, 9 aa, Homo Sapiens
CHEKSTGLQ

SEQ ID NO: 1389422 - protein, 9 aa, Homo Sapiens
CSMQMRRRS

SEQ ID NO: 1389423 - protein, 9 aa, Homo Sapiens
WPGTDIPIH

SEQ ID NO: 1389424 - protein, 9 aa, Homo Sapiens
SFSDLPSGR

SEQ ID NO: 1389425 - protein, 9 aa, Homo Sapiens
PCINPLKSP

SEQ ID NO: 1389426 - protein, 9 aa, Homo Sapiens
ILSDLLAQY

SEQ ID NO: 1389427 - protein, 9 aa, Homo Sapiens
KLFSMFFSQ

SEQ ID NO: 1389428 - protein, 9 aa, Homo Sapiens
SQVETTFCA

SEQ ID NO: 1389429 - protein, 9 aa, Homo Sapiens
FIGTDVGIV

SEQ ID NO: 1389430 - protein, 9 aa, Homo Sapiens
DLEEAVDSV

SEQ ID NO: 1389431 - protein, 9 aa, Homo Sapiens
GEEEEEEDD

SEQ ID NO: 1389432 - protein, 9 aa, Homo Sapiens
AQLQGFLIL

SEQ ID NO: 1389433 - protein, 9 aa, Homo Sapiens
LVPGDLPWR

SEQ ID NO: 1389434 - protein, 9 aa, Homo Sapiens
KGIKIYQLQ

SEQ ID NO: 1389435 - protein, 9 aa, Homo Sapiens
EVTFPPGTA

SEQ ID NO: 1389436 - protein, 9 aa, Homo Sapiens
EVMLDDEEE

SEQ ID NO: 1389437 - protein, 9 aa, Homo Sapiens
CHLVILSPK

SEQ ID NO: 1389438 - protein, 9 aa, Homo Sapiens
IPLERRSPQ

SEQ ID NO: 1389439 - protein, 9 aa, Homo Sapiens
PGPCIGEES

SEQ ID NO: 1389440 - protein, 9 aa, Homo Sapiens
QLPMTSRYN

SEQ ID NO: 1389441 - protein, 9 aa, Homo Sapiens
SFSGVPTQL

SEQ ID NO: 1389442 - protein, 9 aa, Homo Sapiens
LVMVNGVQS

SEQ ID NO: 1389443 - protein, 9 aa, Homo Sapiens
PTKSGTHSP

SEQ ID NO: 1389444 - protein, 9 aa, Homo Sapiens
AVREQHGIQ

SEQ ID NO: 1389445 - protein, 9 aa, Homo Sapiens
KPLEAMLRY

SEQ ID NO: 1389446 - protein, 9 aa, Homo Sapiens
DDGDPPRSS

SEQ ID NO: 1389447 - protein, 9 aa, Homo Sapiens
LKKSDGIWK

SEQ ID NO: 1389448 - protein, 9 aa, Homo Sapiens
AVTVLLTRT

SEQ ID NO: 1389449 - protein, 9 aa, Homo Sapiens
GATSAAGAQ

SEQ ID NO: 1389450 - protein, 9 aa, Homo Sapiens
VSRGKAPQR

SEQ ID NO: 1389451 - protein, 9 aa, Homo Sapiens
EIPRKGQKF

SEQ ID NO: 1389452 - protein, 9 aa, Homo Sapiens
ERSHGRERR

SEQ ID NO: 1389453 - protein, 9 aa, Homo Sapiens
AMLMAVDWT

SEQ ID NO: 1389454 - protein, 9 aa, Homo Sapiens
QLEYTACLD

SEQ ID NO: 1389455 - protein, 9 aa, Homo Sapiens
GEAKRWEPF

SEQ ID NO: 1389456 - protein, 9 aa, Homo Sapiens
GARHGRFRR

SEQ ID NO: 1389457 - protein, 9 aa, Homo Sapiens
IAHLPLPSE

SEQ ID NO: 1389458 - protein, 9 aa, Homo Sapiens
TQWKVTVTP

SEQ ID NO: 1389459 - protein, 9 aa, Homo Sapiens
TPVDRSTPV

SEQ ID NO: 1389460 - protein, 9 aa, Homo Sapiens
PCILYCAPS

SEQ ID NO: 1389461 - protein, 9 aa, Homo Sapiens
VNMGGNRSI

SEQ ID NO: 1389462 - protein, 9 aa, Homo Sapiens
SPSYLPKQP

SEQ ID NO: 1389463 - protein, 9 aa, Homo Sapiens
LSRDVPQET

SEQ ID NO: 1389464 - protein, 9 aa, Homo Sapiens
DLFLRISRP

SEQ ID NO: 1389465 - protein, 9 aa, Homo Sapiens
KSGTHSPAD

SEQ ID NO: 1389466 - protein, 9 aa, Homo Sapiens
WRPTAIRQT

SEQ ID NO: 1389467 - protein, 9 aa, Homo Sapiens
EDDEEAQGS

SEQ ID NO: 1389468 - protein, 9 aa, Homo Sapiens
QKNVKVKKV

SEQ ID NO: 1389469 - protein, 9 aa, Homo Sapiens
FLRISRPPV

SEQ ID NO: 1389470 - protein, 9 aa, Homo Sapiens
SLGRNPTLF

SEQ ID NO: 1389471 - protein, 9 aa, Homo Sapiens
KRVNTAWKT

SEQ ID NO: 1389472 - protein, 9 aa, Homo Sapiens
RRMSVRIVK

SEQ ID NO: 1389473 - protein, 9 aa, Homo Sapiens
GTGVNLGQG

SEQ ID NO: 1389474 - protein, 9 aa, Homo Sapiens
SFSHAPPVA

SEQ ID NO: 1389475 - protein, 9 aa, Homo Sapiens
WRRSRTSGL

SEQ ID NO: 1389476 - protein, 9 aa, Homo Sapiens
EVVKAFVTL

SEQ ID NO: 1389477 - protein, 9 aa, Homo Sapiens
EELKEARHA

SEQ ID NO: 1389478 - protein, 9 aa, Homo Sapiens
LGDASKTLD

SEQ ID NO: 1389479 - protein, 9 aa, Homo Sapiens
FRSYYEQKN

SEQ ID NO: 1389480 - protein, 9 aa, Homo Sapiens
QRRRGAGVS

SEQ ID NO: 1389481 - protein, 9 aa, Homo Sapiens
ASLLSTLSQ

SEQ ID NO: 1389482 - protein, 9 aa, Homo Sapiens
PPELVVEIV

SEQ ID NO: 1389483 - protein, 9 aa, Homo Sapiens
LPLYFAVDP

SEQ ID NO: 1389484 - protein, 9 aa, Homo Sapiens
LENTDSGDR

SEQ ID NO: 1389485 - protein, 9 aa, Homo Sapiens
LRLPSLRTI

SEQ ID NO: 1389486 - protein, 9 aa, Homo Sapiens
DYFKNVARR

SEQ ID NO: 1389487 - protein, 9 aa, Homo Sapiens
CSWMTWSVR

SEQ ID NO: 1389488 - protein, 9 aa, Homo Sapiens
SRKCKHRKR

SEQ ID NO: 1389489 - protein, 9 aa, Homo Sapiens
GQKFGLDLQ

SEQ ID NO: 1389490 - protein, 9 aa, Homo Sapiens
GPAAPPWLH

SEQ ID NO: 1389491 - protein, 9 aa, Homo Sapiens
ARKHSEVML

SEQ ID NO: 1389492 - protein, 9 aa, Homo Sapiens
PHLCLLAPP

SEQ ID NO: 1389493 - protein, 9 aa, Homo Sapiens
RHQKFTHFY

SEQ ID NO: 1389494 - protein, 9 aa, Homo Sapiens
RIFIPMTSH

SEQ ID NO: 1389495 - protein, 9 aa, Homo Sapiens
SSKSTTEVI

SEQ ID NO: 1389496 - protein, 9 aa, Homo Sapiens
SPTPGCIRV

SEQ ID NO: 1389497 - protein, 9 aa, Homo Sapiens
GHREASIHT

SEQ ID NO: 1389498 - protein, 9 aa, Homo Sapiens
EGKGRSHVQ

SEQ ID NO: 1389499 - protein, 9 aa, Homo Sapiens
RFVASLWGG

SEQ ID NO: 1389500 - protein, 9 aa, Homo Sapiens
PGCIRVRTC

SEQ ID NO: 1389501 - protein, 9 aa, Homo Sapiens
SLPLDMYEC

SEQ ID NO: 1389502 - protein, 9 aa, Homo Sapiens
PAGHFTQDK

SEQ ID NO: 1389503 - protein, 9 aa, Homo Sapiens
TPAQDGPCG

SEQ ID NO: 1389504 - protein, 9 aa, Homo Sapiens
RFVASLWGW

SEQ ID NO: 1389505 - protein, 9 aa, Homo Sapiens
AWKTKKTSF

SEQ ID NO: 1389506 - protein, 9 aa, Homo Sapiens
RDSEKMSRI

SEQ ID NO: 1389507 - protein, 9 aa, Homo Sapiens
ETSYYKSLN

SEQ ID NO: 1389508 - protein, 9 aa, Homo Sapiens
VLECLTAEI

SEQ ID NO: 1389509 - protein, 9 aa, Homo Sapiens
FPYRTAGVN

SEQ ID NO: 1389510 - protein, 9 aa, Homo Sapiens
ASSAPSSMT

SEQ ID NO: 1389511 - protein, 9 aa, Homo Sapiens
NNFLKHKLN

SEQ ID NO: 1389512 - protein, 9 aa, Homo Sapiens
MWPERIHQS

SEQ ID NO: 1389513 - protein, 9 aa, Homo Sapiens
LESSKNAEP

SEQ ID NO: 1389514 - protein, 9 aa, Homo Sapiens
PWLHRLWWP

SEQ ID NO: 1389515 - protein, 9 aa, Homo Sapiens
LSPQRSSQS

SEQ ID NO: 1389516 - protein, 9 aa, Homo Sapiens
MTRPSALDR

SEQ ID NO: 1389517 - protein, 9 aa, Homo Sapiens
AVDGWVEEW

SEQ ID NO: 1389518 - protein, 9 aa, Homo Sapiens
VLTLTKMIL

SEQ ID NO: 1389519 - protein, 9 aa, Homo Sapiens
EMRGVFLFT

SEQ ID NO: 1389520 - protein, 9 aa, Homo Sapiens
WQVMASLTG

SEQ ID NO: 1389521 - protein, 9 aa, Homo Sapiens
YIMSTTGWL

SEQ ID NO: 1389522 - protein, 9 aa, Homo Sapiens
WYHQVVGAQ

SEQ ID NO: 1389523 - protein, 9 aa, Homo Sapiens
GRAGPAAAL

SEQ ID NO: 1389524 - protein, 9 aa, Homo Sapiens
IYSCNVFLG

SEQ ID NO: 1389525 - protein, 9 aa, Homo Sapiens
IKSVCSRER

SEQ ID NO: 1389526 - protein, 9 aa, Homo Sapiens
CRSRLEVMH

SEQ ID NO: 1389527 - protein, 9 aa, Homo Sapiens
LKKEWLILK

SEQ ID NO: 1389528 - protein, 9 aa, Homo Sapiens
FEMTIKFAP

SEQ ID NO: 1389529 - protein, 9 aa, Homo Sapiens
PCASLLSTL

SEQ ID NO: 1389530 - protein, 9 aa, Homo Sapiens
RYVLFHPEA

SEQ ID NO: 1389531 - protein, 9 aa, Homo Sapiens
SQSLICFHV

SEQ ID NO: 1389532 - protein, 9 aa, Homo Sapiens
LAVSYAGSA

SEQ ID NO: 1389533 - protein, 9 aa, Homo Sapiens
SLLTLMDDI

SEQ ID NO: 1389534 - protein, 9 aa, Homo Sapiens
VDPEMAVKL

SEQ ID NO: 1389535 - protein, 9 aa, Homo Sapiens
PSALDRCRG

SEQ ID NO: 1389536 - protein, 9 aa, Homo Sapiens
THLPSAPAA

SEQ ID NO: 1389537 - protein, 9 aa, Homo Sapiens
WCWGDISRE

SEQ ID NO: 1389538 - protein, 9 aa, Homo Sapiens
CCYCPAHEV

SEQ ID NO: 1389539 - protein, 9 aa, Homo Sapiens
AKKRIMWLL

SEQ ID NO: 1389540 - protein, 9 aa, Homo Sapiens
DSGSKPRGD

SEQ ID NO: 1389541 - protein, 9 aa, Homo Sapiens
KKEQKKGKR

SEQ ID NO: 1389542 - protein, 9 aa, Homo Sapiens
VILSPKSQT

SEQ ID NO: 1389543 - protein, 9 aa, Homo Sapiens
PAPPAALVS

SEQ ID NO: 1389544 - protein, 9 aa, Homo Sapiens
MLQEAERYK

SEQ ID NO: 1389545 - protein, 9 aa, Homo Sapiens
YSTIMSQRV

SEQ ID NO: 1389546 - protein, 9 aa, Homo Sapiens
WRPPSPWNR

SEQ ID NO: 1389547 - protein, 9 aa, Homo Sapiens
MKRFLTLAS

SEQ ID NO: 1389548 - protein, 9 aa, Homo Sapiens
QPDDNKPPI

SEQ ID NO: 1389549 - protein, 9 aa, Homo Sapiens
NGKKGALVI

SEQ ID NO: 1389550 - protein, 9 aa, Homo Sapiens
HLATGAMKV

SEQ ID NO: 1389551 - protein, 9 aa, Homo Sapiens
LEKLHSEME

SEQ ID NO: 1389552 - protein, 9 aa, Homo Sapiens
LSKKRKPKV

SEQ ID NO: 1389553 - protein, 9 aa, Homo Sapiens
FFMPELVDT

SEQ ID NO: 1389554 - protein, 9 aa, Homo Sapiens
VLPCTLLPK

SEQ ID NO: 1389555 - protein, 9 aa, Homo Sapiens
TQFLRSVFE

SEQ ID NO: 1389556 - protein, 9 aa, Homo Sapiens
PITVTRMRQ

SEQ ID NO: 1389557 - protein, 9 aa, Homo Sapiens
RGLASVGAT

SEQ ID NO: 1389558 - protein, 9 aa, Homo Sapiens
PCFLRSGMR

SEQ ID NO: 1389559 - protein, 9 aa, Homo Sapiens
KEARHALSW

SEQ ID NO: 1389560 - protein, 9 aa, Homo Sapiens
PLTMGWPRF

SEQ ID NO: 1389561 - protein, 9 aa, Homo Sapiens
GRSGSRIPS

SEQ ID NO: 1389562 - protein, 9 aa, Homo Sapiens
TCRCTTPPA

SEQ ID NO: 1389563 - protein, 9 aa, Homo Sapiens
AFIFDGRHV

SEQ ID NO: 1389564 - protein, 9 aa, Homo Sapiens
CLCPLASQA

SEQ ID NO: 1389565 - protein, 9 aa, Homo Sapiens
MEVYAWAPK

SEQ ID NO: 1389566 - protein, 9 aa, Homo Sapiens
SCPFQSPTK

SEQ ID NO: 1389567 - protein, 9 aa, Homo Sapiens
GLLCSSKST

SEQ ID NO: 1389568 - protein, 9 aa, Homo Sapiens
LPACAQWSP

SEQ ID NO: 1389569 - protein, 9 aa, Homo Sapiens
LRAARAHQR

SEQ ID NO: 1389570 - protein, 9 aa, Homo Sapiens
QVGVKIVMC

SEQ ID NO: 1389571 - protein, 9 aa, Homo Sapiens
HSLETGAPL

SEQ ID NO: 1389572 - protein, 9 aa, Homo Sapiens
HKGPPPRPP

SEQ ID NO: 1389573 - protein, 9 aa, Homo Sapiens
GELPLLLAA

SEQ ID NO: 1389574 - protein, 9 aa, Homo Sapiens
AAPPLTNTS

SEQ ID NO: 1389575 - protein, 9 aa, Homo Sapiens
GKKMTASSI

SEQ ID NO: 1389576 - protein, 9 aa, Homo Sapiens
EMKRRISSS

SEQ ID NO: 1389577 - protein, 9 aa, Homo Sapiens
IELIERLNN

SEQ ID NO: 1389578 - protein, 9 aa, Homo Sapiens
KAITDHVSD

SEQ ID NO: 1389579 - protein, 9 aa, Homo Sapiens
TNVEKRRQN

SEQ ID NO: 1389580 - protein, 9 aa, Homo Sapiens
PGIPGDRGL

SEQ ID NO: 1389581 - protein, 9 aa, Homo Sapiens
VFGQASLID

SEQ ID NO: 1389582 - protein, 9 aa, Homo Sapiens
PASPWLPIP

SEQ ID NO: 1389583 - protein, 9 aa, Homo Sapiens
HWTCGLGSS

SEQ ID NO: 1389584 - protein, 9 aa, Homo Sapiens
VGAGTWTTT

SEQ ID NO: 1389585 - protein, 9 aa, Homo Sapiens
VFDRKKRWE

SEQ ID NO: 1389586 - protein, 9 aa, Homo Sapiens
KVMDRQSFN

SEQ ID NO: 1389587 - protein, 9 aa, Homo Sapiens
LDTSARVSD

SEQ ID NO: 1389588 - protein, 9 aa, Homo Sapiens
RSYYEQKNS

SEQ ID NO: 1389589 - protein, 9 aa, Homo Sapiens
PKTWTFSPR

SEQ ID NO: 1389590 - protein, 9 aa, Homo Sapiens
LAAMQPVQF

SEQ ID NO: 1389591 - protein, 9 aa, Homo Sapiens
LEELRNLRL

SEQ ID NO: 1389592 - protein, 9 aa, Homo Sapiens
HAAGKDVPE

SEQ ID NO: 1389593 - protein, 9 aa, Homo Sapiens
MFELVTSET

SEQ ID NO: 1389594 - protein, 9 aa, Homo Sapiens
MRDRSLSTS

SEQ ID NO: 1389595 - protein, 9 aa, Homo Sapiens
SGVNAKKMV

SEQ ID NO: 1389596 - protein, 9 aa, Homo Sapiens
HIYTDKLKN

SEQ ID NO: 1389597 - protein, 9 aa, Homo Sapiens
AGFQWGESP

SEQ ID NO: 1389598 - protein, 9 aa, Homo Sapiens
GCIRVRTCS

SEQ ID NO: 1389599 - protein, 9 aa, Homo Sapiens
SALHHRLCP

SEQ ID NO: 1389600 - protein, 9 aa, Homo Sapiens
RRDPQDGCN

SEQ ID NO: 1389601 - protein, 9 aa, Homo Sapiens
EYLNKVIKA

SEQ ID NO: 1389602 - protein, 9 aa, Homo Sapiens
LDQWTPTKY

SEQ ID NO: 1389603 - protein, 9 aa, Homo Sapiens
QRTGRQHPP

SEQ ID NO: 1389604 - protein, 9 aa, Homo Sapiens
AAPPSLRAA

SEQ ID NO: 1389605 - protein, 9 aa, Homo Sapiens
SITSIFLIP

SEQ ID NO: 1389606 - protein, 9 aa, Homo Sapiens
HPGQQDGKE

SEQ ID NO: 1389607 - protein, 9 aa, Homo Sapiens
GFLILPGSQ

SEQ ID NO: 1389608 - protein, 9 aa, Homo Sapiens
LPILNVALT

SEQ ID NO: 1389609 - protein, 9 aa, Homo Sapiens
ICVRSAVEQ

SEQ ID NO: 1389610 - protein, 9 aa, Homo Sapiens
KRSKEPNLV

SEQ ID NO: 1389611 - protein, 9 aa, Homo Sapiens
HYSMDLFSS

SEQ ID NO: 1389612 - protein, 9 aa, Homo Sapiens
PAALVSWKQ

SEQ ID NO: 1389613 - protein, 9 aa, Homo Sapiens
RLTNSLMDK

SEQ ID NO: 1389614 - protein, 9 aa, Homo Sapiens
IKCDMSVLQ

SEQ ID NO: 1389615 - protein, 9 aa, Homo Sapiens
KHSSSQCTQ

SEQ ID NO: 1389616 - protein, 9 aa, Homo Sapiens
LPTDVECSR

SEQ ID NO: 1389617 - protein, 9 aa, Homo Sapiens
GLRHALSHG

SEQ ID NO: 1389618 - protein, 9 aa, Homo Sapiens
HVLDGLHNE

SEQ ID NO: 1389619 - protein, 9 aa, Homo Sapiens
TQHSIPAME

SEQ ID NO: 1389620 - protein, 9 aa, Homo Sapiens
TEGSEEEGK

SEQ ID NO: 1389621 - protein, 9 aa, Homo Sapiens
FKSRNSYLA

SEQ ID NO: 1389622 - protein, 9 aa, Homo Sapiens
GSETGLCGA

SEQ ID NO: 1389623 - protein, 9 aa, Homo Sapiens
DLLKVGTAS

SEQ ID NO: 1389624 - protein, 9 aa, Homo Sapiens
PRLPLKWKE

SEQ ID NO: 1389625 - protein, 9 aa, Homo Sapiens
IFRDWHSQR

SEQ ID NO: 1389626 - protein, 9 aa, Homo Sapiens
CITAHEALK

SEQ ID NO: 1389627 - protein, 9 aa, Homo Sapiens
QENYGDVYG

SEQ ID NO: 1389628 - protein, 9 aa, Homo Sapiens
LPKDRYVTP

SEQ ID NO: 1389629 - protein, 9 aa, Homo Sapiens
EGILYKRGA

SEQ ID NO: 1389630 - protein, 9 aa, Homo Sapiens
MPQMQLQAL

SEQ ID NO: 1389631 - protein, 9 aa, Homo Sapiens
TPSTPVDRS

SEQ ID NO: 1389632 - protein, 9 aa, Homo Sapiens
ILYCAPSNK

SEQ ID NO: 1389633 - protein, 9 aa, Homo Sapiens
AHQRTGRQH

SEQ ID NO: 1389634 - protein, 9 aa, Homo Sapiens
HTQRQPWVL

SEQ ID NO: 1389635 - protein, 9 aa, Homo Sapiens
IEGGADGSI

SEQ ID NO: 1389636 - protein, 9 aa, Homo Sapiens
LQLVVLDVD

SEQ ID NO: 1389637 - protein, 9 aa, Homo Sapiens
KVVSGIDLT

SEQ ID NO: 1389638 - protein, 9 aa, Homo Sapiens
YFHLWTRQR

SEQ ID NO: 1389639 - protein, 9 aa, Homo Sapiens
KCGAVREQH

SEQ ID NO: 1389640 - protein, 9 aa, Homo Sapiens
NRIQRCIAD

SEQ ID NO: 1389641 - protein, 9 aa, Homo Sapiens
DEIPRKGQK

SEQ ID NO: 1389642 - protein, 9 aa, Homo Sapiens
CLNETQDKA

SEQ ID NO: 1389643 - protein, 9 aa, Homo Sapiens
RYRSCALSY

SEQ ID NO: 1389644 - protein, 9 aa, Homo Sapiens
WMYDTVQRT

SEQ ID NO: 1389645 - protein, 9 aa, Homo Sapiens
GRSGRALPL

SEQ ID NO: 1389646 - protein, 9 aa, Homo Sapiens
LAEPLWKEL

SEQ ID NO: 1389647 - protein, 9 aa, Homo Sapiens
LPELGLNQE

SEQ ID NO: 1389648 - protein, 9 aa, Homo Sapiens
RDRSVHNLT

SEQ ID NO: 1389649 - protein, 9 aa, Homo Sapiens
FLIPSLSRS

SEQ ID NO: 1389650 - protein, 9 aa, Homo Sapiens
RDIKPANMF

SEQ ID NO: 1389651 - protein, 9 aa, Homo Sapiens
EISSVQKKM

SEQ ID NO: 1389652 - protein, 9 aa, Homo Sapiens
LHHFHTHPI

SEQ ID NO: 1389653 - protein, 9 aa, Homo Sapiens
DLNYLRVLN

SEQ ID NO: 1389654 - protein, 9 aa, Homo Sapiens
NFFWVGGAA

SEQ ID NO: 1389655 - protein, 9 aa, Homo Sapiens
IIRDTIPNI

SEQ ID NO: 1389656 - protein, 9 aa, Homo Sapiens
QSQNQRGLA

SEQ ID NO: 1389657 - protein, 9 aa, Homo Sapiens
HPSWPWTRC

SEQ ID NO: 1389658 - protein, 9 aa, Homo Sapiens
TKGFSESSH

SEQ ID NO: 1389659 - protein, 9 aa, Homo Sapiens
QLLWLGAHA

SEQ ID NO: 1389660 - protein, 9 aa, Homo Sapiens
CNWTPESPG

SEQ ID NO: 1389661 - protein, 9 aa, Homo Sapiens
DHSTDKNGF

SEQ ID NO: 1389662 - protein, 9 aa, Homo Sapiens
VQCIQEALH

SEQ ID NO: 1389663 - protein, 9 aa, Homo Sapiens
IQKVILWDL

SEQ ID NO: 1389664 - protein, 9 aa, Homo Sapiens
RAKVLDQSD

SEQ ID NO: 1389665 - protein, 9 aa, Homo Sapiens
WRGVGETPG

SEQ ID NO: 1389666 - protein, 9 aa, Homo Sapiens
SSQKSVPCV

SEQ ID NO: 1389667 - protein, 9 aa, Homo Sapiens
SFLKEHLLS

SEQ ID NO: 1389668 - protein, 9 aa, Homo Sapiens
SISLYWGNC

SEQ ID NO: 1389669 - protein, 9 aa, Homo Sapiens
YGEDYFHIY

SEQ ID NO: 1389670 - protein, 9 aa, Homo Sapiens
HTGGSHCST

SEQ ID NO: 1389671 - protein, 9 aa, Homo Sapiens
QKIQHSITT

SEQ ID NO: 1389672 - protein, 9 aa, Homo Sapiens
RSKYSGTHH

SEQ ID NO: 1389673 - protein, 9 aa, Homo Sapiens
EFHLSRILP

SEQ ID NO: 1389674 - protein, 9 aa, Homo Sapiens
TQTPHYIRR

SEQ ID NO: 1389675 - protein, 9 aa, Homo Sapiens
ESMTLLFEV

SEQ ID NO: 1389676 - protein, 9 aa, Homo Sapiens
TSSMKSCKV

SEQ ID NO: 1389677 - protein, 9 aa, Homo Sapiens
GVLCCYCPA

SEQ ID NO: 1389678 - protein, 9 aa, Homo Sapiens
HIDFEDPAR

SEQ ID NO: 1389679 - protein, 9 aa, Homo Sapiens
QMDQQGQGS

SEQ ID NO: 1389680 - protein, 9 aa, Homo Sapiens
WTQRTSAGC

SEQ ID NO: 1389681 - protein, 9 aa, Homo Sapiens
DLPSGRRTS

SEQ ID NO: 1389682 - protein, 9 aa, Homo Sapiens
KITDEAFYG

SEQ ID NO: 1389683 - protein, 9 aa, Homo Sapiens
AAGKDVPEG

SEQ ID NO: 1389684 - protein, 9 aa, Homo Sapiens
KIYQLQFYL

SEQ ID NO: 1389685 - protein, 9 aa, Homo Sapiens
IMNAFILLP

SEQ ID NO: 1389686 - protein, 9 aa, Homo Sapiens
HQGKEATAV

SEQ ID NO: 1389687 - protein, 9 aa, Homo Sapiens
SAWAPQTAV

SEQ ID NO: 1389688 - protein, 9 aa, Homo Sapiens
VYKLRRKNN

SEQ ID NO: 1389689 - protein, 9 aa, Homo Sapiens
AKRKEAELC

SEQ ID NO: 1389690 - protein, 9 aa, Homo Sapiens
SCTYSALIA

SEQ ID NO: 1389691 - protein, 9 aa, Homo Sapiens
LAATSASGA

SEQ ID NO: 1389692 - protein, 9 aa, Homo Sapiens
VHLVKISCV

SEQ ID NO: 1389693 - protein, 9 aa, Homo Sapiens
IKWLRKCAK

SEQ ID NO: 1389694 - protein, 9 aa, Homo Sapiens
KRPWSQKTE

SEQ ID NO: 1389695 - protein, 9 aa, Homo Sapiens
RLASTTNKL

SEQ ID NO: 1389696 - protein, 9 aa, Homo Sapiens
HPPNYSMVL

SEQ ID NO: 1389697 - protein, 9 aa, Homo Sapiens
APPVAEEAA

SEQ ID NO: 1389698 - protein, 9 aa, Homo Sapiens
LLWDRIVLG

SEQ ID NO: 1389699 - protein, 9 aa, Homo Sapiens
AYQTEGTWD

SEQ ID NO: 1389700 - protein, 9 aa, Homo Sapiens
LGSGDLGNG

SEQ ID NO: 1389701 - protein, 9 aa, Homo Sapiens
SWRSLLSFR

SEQ ID NO: 1389702 - protein, 9 aa, Homo Sapiens
WSLFTGLRS

SEQ ID NO: 1389703 - protein, 9 aa, Homo Sapiens
KRKWKLTSS

SEQ ID NO: 1389704 - protein, 9 aa, Homo Sapiens
RISETSLPL

SEQ ID NO: 1389705 - protein, 9 aa, Homo Sapiens
KMEYSYLDS

SEQ ID NO: 1389706 - protein, 9 aa, Homo Sapiens
VYKRAKVLD

SEQ ID NO: 1389707 - protein, 9 aa, Homo Sapiens
KEPNLVLDE

SEQ ID NO: 1389708 - protein, 9 aa, Homo Sapiens
SRCRSRLEV

SEQ ID NO: 1389709 - protein, 9 aa, Homo Sapiens
ADDVENSAQ

SEQ ID NO: 1389710 - protein, 9 aa, Homo Sapiens
LILQRKKLS

SEQ ID NO: 1389711 - protein, 9 aa, Homo Sapiens
GVQDGAAEE

SEQ ID NO: 1389712 - protein, 9 aa, Homo Sapiens
QSLTPATPQ

SEQ ID NO: 1389713 - protein, 9 aa, Homo Sapiens
AGKDVPEGL

SEQ ID NO: 1389714 - protein, 9 aa, Homo Sapiens
SWMTWSVRI

SEQ ID NO: 1389715 - protein, 9 aa, Homo Sapiens
GEERYGGTR

SEQ ID NO: 1389716 - protein, 9 aa, Homo Sapiens
FSQSLICFH

SEQ ID NO: 1389717 - protein, 9 aa, Homo Sapiens
REEMVKNVL

SEQ ID NO: 1389718 - protein, 9 aa, Homo Sapiens
LVHHKRMHS

SEQ ID NO: 1389719 - protein, 9 aa, Homo Sapiens
QAKACPISR

SEQ ID NO: 1389720 - protein, 9 aa, Homo Sapiens
WTLTMPPSS

SEQ ID NO: 1389721 - protein, 9 aa, Homo Sapiens
QKGKRPQNP

SEQ ID NO: 1389722 - protein, 9 aa, Homo Sapiens
VAQMDEDFS

SEQ ID NO: 1389723 - protein, 9 aa, Homo Sapiens
AGTWTTTSC

SEQ ID NO: 1389724 - protein, 9 aa, Homo Sapiens
GRGALRNTC

SEQ ID NO: 1389725 - protein, 9 aa, Homo Sapiens
PCFIFNNEQ

SEQ ID NO: 1389726 - protein, 9 aa, Homo Sapiens
GDTPQPSLP

SEQ ID NO: 1389727 - protein, 9 aa, Homo Sapiens
NETQDKAFI

SEQ ID NO: 1389728 - protein, 9 aa, Homo Sapiens
ARVSDLHPN

SEQ ID NO: 1389729 - protein, 9 aa, Homo Sapiens
ELGDASKTL

SEQ ID NO: 1389730 - protein, 9 aa, Homo Sapiens
YVTSQQIFG

SEQ ID NO: 1389731 - protein, 9 aa, Homo Sapiens
LRFCFKLMV

SEQ ID NO: 1389732 - protein, 9 aa, Homo Sapiens
IQNSLLHVY

SEQ ID NO: 1389733 - protein, 9 aa, Homo Sapiens
PTPGCIRVR

SEQ ID NO: 1389734 - protein, 9 aa, Homo Sapiens
QWKRPMGLS

SEQ ID NO: 1389735 - protein, 9 aa, Homo Sapiens
EFEQQEWLL

SEQ ID NO: 1389736 - protein, 9 aa, Homo Sapiens
ALSQTGFSY

SEQ ID NO: 1389737 - protein, 9 aa, Homo Sapiens
KKGIKIYQL

SEQ ID NO: 1389738 - protein, 9 aa, Homo Sapiens
IQEALHEHS

SEQ ID NO: 1389739 - protein, 9 aa, Homo Sapiens
KKCPLLLVY

SEQ ID NO: 1389740 - protein, 9 aa, Homo Sapiens
KDDIDRMLQ

SEQ ID NO: 1389741 - protein, 9 aa, Homo Sapiens
TFSPRVTRI

SEQ ID NO: 1389742 - protein, 9 aa, Homo Sapiens
RGPGPLEPW

SEQ ID NO: 1389743 - protein, 9 aa, Homo Sapiens
SPGMQGARG

SEQ ID NO: 1389744 - protein, 9 aa, Homo Sapiens
PFTMHSDRE

SEQ ID NO: 1389745 - protein, 9 aa, Homo Sapiens
PAPPEWKCS

SEQ ID NO: 1389746 - protein, 9 aa, Homo Sapiens
GWSPTPGCI

SEQ ID NO: 1389747 - protein, 9 aa, Homo Sapiens
LHALSKLKK

SEQ ID NO: 1389748 - protein, 9 aa, Homo Sapiens
PNLKSVDFE

SEQ ID NO: 1389749 - protein, 9 aa, Homo Sapiens
STTTGPCPA

SEQ ID NO: 1389750 - protein, 9 aa, Homo Sapiens
PVAHCFAPR

SEQ ID NO: 1389751 - protein, 9 aa, Homo Sapiens
STKPQKNVK

SEQ ID NO: 1389752 - protein, 9 aa, Homo Sapiens
PELVVEIVL

SEQ ID NO: 1389753 - protein, 9 aa, Homo Sapiens
LSLKDSRPL

SEQ ID NO: 1389754 - protein, 9 aa, Homo Sapiens
GGACATCSW

SEQ ID NO: 1389755 - protein, 9 aa, Homo Sapiens
IVMCWRPPS

SEQ ID NO: 1389756 - protein, 9 aa, Homo Sapiens
AFAQGMRRN

SEQ ID NO: 1389757 - protein, 9 aa, Homo Sapiens
PILNVALTS

SEQ ID NO: 1389758 - protein, 9 aa, Homo Sapiens
SDLHPNTKY

SEQ ID NO: 1389759 - protein, 9 aa, Homo Sapiens
KLILDHNPL

SEQ ID NO: 1389760 - protein, 9 aa, Homo Sapiens
CALWGWFSA

SEQ ID NO: 1389761 - protein, 9 aa, Homo Sapiens
ILKLQRGIY

SEQ ID NO: 1389762 - protein, 9 aa, Homo Sapiens
PTISCPFQS

SEQ ID NO: 1389763 - protein, 8 aa, Homo Sapiens
TDPLLDSQ

SEQ ID NO: 1389764 - protein, 9 aa, Homo Sapiens
YFDRNPHFQ

SEQ ID NO: 1389765 - protein, 9 aa, Homo Sapiens
LGLLIEVSE

SEQ ID NO: 1389766 - protein, 9 aa, Homo Sapiens
GPCGFPGGG

SEQ ID NO: 1389767 - protein, 9 aa, Homo Sapiens
LLKTNWKNM

SEQ ID NO: 1389768 - protein, 9 aa, Homo Sapiens
KEWLILKGL

SEQ ID NO: 1389769 - protein, 9 aa, Homo Sapiens
TWEVPFADL

SEQ ID NO: 1389770 - protein, 9 aa, Homo Sapiens
GESPWQVMA

SEQ ID NO: 1389771 - protein, 9 aa, Homo Sapiens
PPAVLGAGV

SEQ ID NO: 1389772 - protein, 9 aa, Homo Sapiens
RGKAPQREA

SEQ ID NO: 1389773 - protein, 9 aa, Homo Sapiens
GLLEGSAEI

SEQ ID NO: 1389774 - protein, 9 aa, Homo Sapiens
ELRGGGGGQ

SEQ ID NO: 1389775 - protein, 9 aa, Homo Sapiens
KRGSRSKTR

SEQ ID NO: 1389776 - protein, 9 aa, Homo Sapiens
HLACPEAWG

SEQ ID NO: 1389777 - protein, 9 aa, Homo Sapiens
YRYSMAHSA

SEQ ID NO: 1389778 - protein, 9 aa, Homo Sapiens
YLKKKTRTS

SEQ ID NO: 1389779 - protein, 9 aa, Homo Sapiens
AYGRLWRPT

SEQ ID NO: 1389780 - protein, 9 aa, Homo Sapiens
LDVSSISHW

SEQ ID NO: 1389781 - protein, 9 aa, Homo Sapiens
VLILQRKKL

SEQ ID NO: 1389782 - protein, 9 aa, Homo Sapiens
NGKKIGDSG

SEQ ID NO: 1389783 - protein, 9 aa, Homo Sapiens
VKGMNSHVP

SEQ ID NO: 1389784 - protein, 9 aa, Homo Sapiens
LQGPPGAAG

SEQ ID NO: 1389785 - protein, 9 aa, Homo Sapiens
LEALAVHRQ

SEQ ID NO: 1389786 - protein, 9 aa, Homo Sapiens
SESHKLFSF

SEQ ID NO: 1389787 - protein, 9 aa, Homo Sapiens
RMRYVLFHP

SEQ ID NO: 1389788 - protein, 9 aa, Homo Sapiens
SPRISVCGC

SEQ ID NO: 1389789 - protein, 9 aa, Homo Sapiens
IIRSLQHFT

SEQ ID NO: 1389790 - protein, 9 aa, Homo Sapiens
FVRENNSPP

SEQ ID NO: 1389791 - protein, 9 aa, Homo Sapiens
RRNLQRNLK

SEQ ID NO: 1389792 - protein, 9 aa, Homo Sapiens
SYLPKQPDL

SEQ ID NO: 1389793 - protein, 9 aa, Homo Sapiens
ISILIAYNG

SEQ ID NO: 1389794 - protein, 9 aa, Homo Sapiens
LPGLDVVAQ

SEQ ID NO: 1389795 - protein, 9 aa, Homo Sapiens
KRSSRSNAY

SEQ ID NO: 1389796 - protein, 9 aa, Homo Sapiens
LDQICLKKG

SEQ ID NO: 1389797 - protein, 9 aa, Homo Sapiens
ENCFYLHIS

SEQ ID NO: 1389798 - protein, 9 aa, Homo Sapiens
TSSSGCTSS

SEQ ID NO: 1389799 - protein, 9 aa, Homo Sapiens
SSTGRPASA

SEQ ID NO: 1389800 - protein, 9 aa, Homo Sapiens
LTDVQQLVY

SEQ ID NO: 1389801 - protein, 9 aa, Homo Sapiens
RGPPGPNEA

SEQ ID NO: 1389802 - protein, 9 aa, Homo Sapiens
ILDHNPLTT

SEQ ID NO: 1389803 - protein, 9 aa, Homo Sapiens
APTCVSSTT

SEQ ID NO: 1389804 - protein, 9 aa, Homo Sapiens
SAVGLSTWS

SEQ ID NO: 1389805 - protein, 9 aa, Homo Sapiens
MHGTVDCNG

SEQ ID NO: 1389806 - protein, 9 aa, Homo Sapiens
RKEKTAKMK

SEQ ID NO: 1389807 - protein, 9 aa, Homo Sapiens
PDGDYQTGF

SEQ ID NO: 1389808 - protein, 9 aa, Homo Sapiens
IVVHPSRSP

SEQ ID NO: 1389809 - protein, 9 aa, Homo Sapiens
PPGRPGLQG

SEQ ID NO: 1389810 - protein, 9 aa, Homo Sapiens
EFLLLWMSE

SEQ ID NO: 1389811 - protein, 9 aa, Homo Sapiens
IGREVATQM

SEQ ID NO: 1389812 - protein, 9 aa, Homo Sapiens
CALSYGRRK

SEQ ID NO: 1389813 - protein, 9 aa, Homo Sapiens
GLLGLPGPK

SEQ ID NO: 1389814 - protein, 9 aa, Homo Sapiens
QDVQSLLAP

SEQ ID NO: 1389815 - protein, 9 aa, Homo Sapiens
NHLLDGGSN

SEQ ID NO: 1389816 - protein, 9 aa, Homo Sapiens
VTQTPHYIR

SEQ ID NO: 1389817 - protein, 9 aa, Homo Sapiens
KEVAVGQVL

SEQ ID NO: 1389818 - protein, 9 aa, Homo Sapiens
SGGQFRAGP

SEQ ID NO: 1389819 - protein, 9 aa, Homo Sapiens
SGMSQTVTQ

SEQ ID NO: 1389820 - protein, 9 aa, Homo Sapiens
VHQPQPMEK

SEQ ID NO: 1389821 - protein, 9 aa, Homo Sapiens
RKCAKITSV

SEQ ID NO: 1389822 - protein, 9 aa, Homo Sapiens
TQYIAVRTV

SEQ ID NO: 1389823 - protein, 9 aa, Homo Sapiens
HREASIHTS

SEQ ID NO: 1389824 - protein, 9 aa, Homo Sapiens
PTSPKAQPT

SEQ ID NO: 1389825 - protein, 9 aa, Homo Sapiens
CDITAWGGE

SEQ ID NO: 1389826 - protein, 9 aa, Homo Sapiens
VMDRQSFNK

SEQ ID NO: 1389827 - protein, 9 aa, Homo Sapiens
SSSAVSSLK

SEQ ID NO: 1389828 - protein, 9 aa, Homo Sapiens
RESIKREIQ

SEQ ID NO: 1389829 - protein, 9 aa, Homo Sapiens
RSVFETLPG

SEQ ID NO: 1389830 - protein, 9 aa, Homo Sapiens
SISENAPVG

SEQ ID NO: 1389831 - protein, 9 aa, Homo Sapiens
RAPRRCQRK

SEQ ID NO: 1389832 - protein, 9 aa, Homo Sapiens
CHVDATGQQ

SEQ ID NO: 1389833 - protein, 9 aa, Homo Sapiens
RRCLCADYF

SEQ ID NO: 1389834 - protein, 9 aa, Homo Sapiens
WASSVLQGH

SEQ ID NO: 1389835 - protein, 9 aa, Homo Sapiens
LYCAPSNKS

SEQ ID NO: 1389836 - protein, 9 aa, Homo Sapiens
PTAIRQTLY

SEQ ID NO: 1389837 - protein, 9 aa, Homo Sapiens
DEHFELDVV

SEQ ID NO: 1389838 - protein, 9 aa, Homo Sapiens
QPALTLEEY

SEQ ID NO: 1389839 - protein, 9 aa, Homo Sapiens
PTDVECSRY

SEQ ID NO: 1389840 - protein, 9 aa, Homo Sapiens
RRHVFGKSD

SEQ ID NO: 1389841 - protein, 9 aa, Homo Sapiens
PPWALMSPR

SEQ ID NO: 1389842 - protein, 9 aa, Homo Sapiens
NIESTSMST

SEQ ID NO: 1389843 - protein, 9 aa, Homo Sapiens
VPGPGKPTL

SEQ ID NO: 1389844 - protein, 9 aa, Homo Sapiens
RGRFMFQKS

SEQ ID NO: 1389845 - protein, 9 aa, Homo Sapiens
RSVHNLTEG

SEQ ID NO: 1389846 - protein, 9 aa, Homo Sapiens
EKEHEKDQD

SEQ ID NO: 1389847 - protein, 9 aa, Homo Sapiens
GIRWDTIIF

SEQ ID NO: 1389848 - protein, 9 aa, Homo Sapiens
IFFSPGIGS

SEQ ID NO: 1389849 - protein, 9 aa, Homo Sapiens
TTQDHQPTP

SEQ ID NO: 1389850 - protein, 9 aa, Homo Sapiens
YAGSARVGT

SEQ ID NO: 1389851 - protein, 9 aa, Homo Sapiens
VLYHIAQNE

SEQ ID NO: 1389852 - protein, 9 aa, Homo Sapiens
YKEDMKELV

SEQ ID NO: 1389853 - protein, 9 aa, Homo Sapiens
SLQHFTTGR

SEQ ID NO: 1389854 - protein, 9 aa, Homo Sapiens
PVRPMGARA

SEQ ID NO: 1389855 - protein, 9 aa, Homo Sapiens
PAVLGAGVH

SEQ ID NO: 1389856 - protein, 9 aa, Homo Sapiens
FSMFFSQSL

SEQ ID NO: 1389857 - protein, 9 aa, Homo Sapiens
PALTLEEYY

SEQ ID NO: 1389858 - protein, 9 aa, Homo Sapiens
KVSFQPSGE

SEQ ID NO: 1389859 - protein, 9 aa, Homo Sapiens
GYRERGGGC

SEQ ID NO: 1389860 - protein, 9 aa, Homo Sapiens
SSRSNAYFY

SEQ ID NO: 1389861 - protein, 9 aa, Homo Sapiens
TNLQAALDD

SEQ ID NO: 1389862 - protein, 9 aa, Homo Sapiens
LIERLNNPP

SEQ ID NO: 1389863 - protein, 9 aa, Homo Sapiens
RLLLKHLQP

SEQ ID NO: 1389864 - protein, 9 aa, Homo Sapiens
KTRTCSWQV

SEQ ID NO: 1389865 - protein, 9 aa, Homo Sapiens
QHSLGPSLA

SEQ ID NO: 1389866 - protein, 9 aa, Homo Sapiens
WLSPISACP

SEQ ID NO: 1389867 - protein, 9 aa, Homo Sapiens
HPDVAHLAC

SEQ ID NO: 1389868 - protein, 9 aa, Homo Sapiens
KTNWKNMVR

SEQ ID NO: 1389869 - protein, 9 aa, Homo Sapiens
LLPYPFHVL

SEQ ID NO: 1389870 - protein, 9 aa, Homo Sapiens
MAVDWTLTK

SEQ ID NO: 1389871 - protein, 9 aa, Homo Sapiens
TSTWMTCPP

SEQ ID NO: 1389872 - protein, 9 aa, Homo Sapiens
ALGGPKAHW

SEQ ID NO: 1389873 - protein, 9 aa, Homo Sapiens
RSFFTSAHP

SEQ ID NO: 1389874 - protein, 9 aa, Homo Sapiens
GFGKILSSQ

SEQ ID NO: 1389875 - protein, 9 aa, Homo Sapiens
SKPRGDEDD

SEQ ID NO: 1389876 - protein, 9 aa, Homo Sapiens
EDRGLTSRI

SEQ ID NO: 1389877 - protein, 9 aa, Homo Sapiens
ANMFITATG

SEQ ID NO: 1389878 - protein, 9 aa, Homo Sapiens
TFRVAIRVL

SEQ ID NO: 1389879 - protein, 9 aa, Homo Sapiens
GKHKIAKFE

SEQ ID NO: 1389880 - protein, 9 aa, Homo Sapiens
YNSTQGMLM

SEQ ID NO: 1389881 - protein, 9 aa, Homo Sapiens
TFSFSLCNF

SEQ ID NO: 1389882 - protein, 9 aa, Homo Sapiens
AVEELHSRR

SEQ ID NO: 1389883 - protein, 9 aa, Homo Sapiens
ECMLKKTSF

SEQ ID NO: 1389884 - protein, 9 aa, Homo Sapiens
ACATCSWMT

SEQ ID NO: 1389885 - protein, 9 aa, Homo Sapiens
IHQGKEATA

SEQ ID NO: 1389886 - protein, 9 aa, Homo Sapiens
GPATMSPWY

SEQ ID NO: 1389887 - protein, 9 aa, Homo Sapiens
YKNPIYSCN

SEQ ID NO: 1389888 - protein, 9 aa, Homo Sapiens
AKRKWKLTS

SEQ ID NO: 1389889 - protein, 9 aa, Homo Sapiens
TASGLKNIP

SEQ ID NO: 1389890 - protein, 9 aa, Homo Sapiens
TLGATSAAG

SEQ ID NO: 1389891 - protein, 9 aa, Homo Sapiens
GVISWIRQV

SEQ ID NO: 1389892 - protein, 9 aa, Homo Sapiens
VSQARLSAR

SEQ ID NO: 1389893 - protein, 9 aa, Homo Sapiens
VSFSGVPTQ

SEQ ID NO: 1389894 - protein, 9 aa, Homo Sapiens
KVLAWWFCR

SEQ ID NO: 1389895 - protein, 9 aa, Homo Sapiens
TLEKHYLSA

SEQ ID NO: 1389896 - protein, 9 aa, Homo Sapiens
PKLKHMSHG

SEQ ID NO: 1389897 - protein, 9 aa, Homo Sapiens
DTTLQELLN

SEQ ID NO: 1389898 - protein, 9 aa, Homo Sapiens
FHYSMDLFS

SEQ ID NO: 1389899 - protein, 9 aa, Homo Sapiens
PVECRNLFA

SEQ ID NO: 1389900 - protein, 9 aa, Homo Sapiens
NREKMPLMI

SEQ ID NO: 1389901 - protein, 9 aa, Homo Sapiens
RRSQQLHHG

SEQ ID NO: 1389902 - protein, 9 aa, Homo Sapiens
TTSEEAQKK

SEQ ID NO: 1389903 - protein, 9 aa, Homo Sapiens
PASHSDVGL

SEQ ID NO: 1389904 - protein, 9 aa, Homo Sapiens
RHMCSMKKT

SEQ ID NO: 1389905 - protein, 9 aa, Homo Sapiens
DHAAALPGQ

SEQ ID NO: 1389906 - protein, 9 aa, Homo Sapiens
SREDKRERT

SEQ ID NO: 1389907 - protein, 9 aa, Homo Sapiens
STATPDQDC

SEQ ID NO: 1389908 - protein, 9 aa, Homo Sapiens
LGGGGIGYE

SEQ ID NO: 1389909 - protein, 9 aa, Homo Sapiens
MVDPEARAP

SEQ ID NO: 1389910 - protein, 9 aa, Homo Sapiens
NELKKTYED

SEQ ID NO: 1389911 - protein, 9 aa, Homo Sapiens
TATCSPSGR

SEQ ID NO: 1389912 - protein, 9 aa, Homo Sapiens
PSTPVDRST

SEQ ID NO: 1389913 - protein, 9 aa, Homo Sapiens
VLLKTNWKN

SEQ ID NO: 1389914 - protein, 9 aa, Homo Sapiens
CIQIIEQSR

SEQ ID NO: 1389915 - protein, 9 aa, Homo Sapiens
HLLGDAHVL

SEQ ID NO: 1389916 - protein, 9 aa, Homo Sapiens
VPYSANLNL

SEQ ID NO: 1389917 - protein, 9 aa, Homo Sapiens
RQLRKAITD

SEQ ID NO: 1389918 - protein, 9 aa, Homo Sapiens
SQQYKLGVR

SEQ ID NO: 1389919 - protein, 9 aa, Homo Sapiens
RYFLWVVKF

SEQ ID NO: 1389920 - protein, 9 aa, Homo Sapiens
CPACCMQKS

SEQ ID NO: 1389921 - protein, 9 aa, Homo Sapiens
VNREPFTMH

SEQ ID NO: 1389922 - protein, 9 aa, Homo Sapiens
KECFESLRM

SEQ ID NO: 1389923 - protein, 9 aa, Homo Sapiens
YSCGICKNH

SEQ ID NO: 1389924 - protein, 9 aa, Homo Sapiens
APWTQRTSA

SEQ ID NO: 1389925 - protein, 9 aa, Homo Sapiens
ALAMGQTTQ

SEQ ID NO: 1389926 - protein, 9 aa, Homo Sapiens
YHWHPSCLT

SEQ ID NO: 1389927 - protein, 9 aa, Homo Sapiens
VDGWVEEWY

SEQ ID NO: 1389928 - protein, 9 aa, Homo Sapiens
PELLVGRLM

SEQ ID NO: 1389929 - protein, 9 aa, Homo Sapiens
SLTCFNQTY

SEQ ID NO: 1389930 - protein, 9 aa, Homo Sapiens
IYIHTHTFY

SEQ ID NO: 1389931 - protein, 9 aa, Homo Sapiens
FRIASIKPI

SEQ ID NO: 1389932 - protein, 9 aa, Homo Sapiens
SQGGRILLQ

SEQ ID NO: 1389933 - protein, 9 aa, Homo Sapiens
QFHSLRRDG

SEQ ID NO: 1389934 - protein, 9 aa, Homo Sapiens
AELGDASKT

SEQ ID NO: 1389935 - protein, 9 aa, Homo Sapiens
NDHYPMFTE

SEQ ID NO: 1389936 - protein, 9 aa, Homo Sapiens
HFQKVLNWS

SEQ ID NO: 1389937 - protein, 9 aa, Homo Sapiens
HVSFGPGGQ

SEQ ID NO: 1389938 - protein, 9 aa, Homo Sapiens
SQVWTAATL

SEQ ID NO: 1389939 - protein, 9 aa, Homo Sapiens
EMLRSIMSG

SEQ ID NO: 1389940 - protein, 9 aa, Homo Sapiens
PHPEIQLCL

SEQ ID NO: 1389941 - protein, 9 aa, Homo Sapiens
ELVTSETSY

SEQ ID NO: 1389942 - protein, 9 aa, Homo Sapiens
GVEAEAVML

SEQ ID NO: 1389943 - protein, 9 aa, Homo Sapiens
LTWMRPKKC

SEQ ID NO: 1389944 - protein, 9 aa, Homo Sapiens
SMKSCKVRL

SEQ ID NO: 1389945 - protein, 9 aa, Homo Sapiens
STGLTGEQT

SEQ ID NO: 1389946 - protein, 9 aa, Homo Sapiens
CFPKNLVAC

SEQ ID NO: 1389947 - protein, 9 aa, Homo Sapiens
GSISGHVRV

SEQ ID NO: 1389948 - protein, 9 aa, Homo Sapiens
QLDPGAGSI

SEQ ID NO: 1389949 - protein, 9 aa, Homo Sapiens
MEGWMGPKC

SEQ ID NO: 1389950 - protein, 9 aa, Homo Sapiens
CIAPVELRH

SEQ ID NO: 1389951 - protein, 9 aa, Homo Sapiens
APSSDPPPG

SEQ ID NO: 1389952 - protein, 9 aa, Homo Sapiens
APHVCQDIP

SEQ ID NO: 1389953 - protein, 9 aa, Homo Sapiens
LTVLDEEVG

SEQ ID NO: 1389954 - protein, 9 aa, Homo Sapiens
VNAVEELHS

SEQ ID NO: 1389955 - protein, 9 aa, Homo Sapiens
FLTLASAHV

SEQ ID NO: 1389956 - protein, 9 aa, Homo Sapiens
AAQLLGMCL

SEQ ID NO: 1389957 - protein, 9 aa, Homo Sapiens
MYTDVISET

SEQ ID NO: 1389958 - protein, 9 aa, Homo Sapiens
WIQAHRLEH

SEQ ID NO: 1389959 - protein, 9 aa, Homo Sapiens
STHLPPSSY

SEQ ID NO: 1389960 - protein, 9 aa, Homo Sapiens
KAFRRFSSP

SEQ ID NO: 1389961 - protein, 9 aa, Homo Sapiens
AAPGLQWPV

SEQ ID NO: 1389962 - protein, 9 aa, Homo Sapiens
ASLWGGPCG

SEQ ID NO: 1389963 - protein, 9 aa, Homo Sapiens
LVAWDPVPY

SEQ ID NO: 1389964 - protein, 9 aa, Homo Sapiens
VLDMLHHFH

SEQ ID NO: 1389965 - protein, 9 aa, Homo Sapiens
TLYGGRSTG

SEQ ID NO: 1389966 - protein, 9 aa, Homo Sapiens
HDIRRSKNR

SEQ ID NO: 1389967 - protein, 9 aa, Homo Sapiens
RRRYRSCAL

SEQ ID NO: 1389968 - protein, 9 aa, Homo Sapiens
PESLEASPT

SEQ ID NO: 1389969 - protein, 9 aa, Homo Sapiens
SSSDSLCSH

SEQ ID NO: 1389970 - protein, 9 aa, Homo Sapiens
DWIEDMLSG

SEQ ID NO: 1389971 - protein, 9 aa, Homo Sapiens
GGSHCSTSF

SEQ ID NO: 1389972 - protein, 9 aa, Homo Sapiens
VSFSLCGVP

SEQ ID NO: 1389973 - protein, 9 aa, Homo Sapiens
QTHLATGAM

SEQ ID NO: 1389974 - protein, 9 aa, Homo Sapiens
RFAACWSPW

SEQ ID NO: 1389975 - protein, 9 aa, Homo Sapiens
APPQCPQAS

SEQ ID NO: 1389976 - protein, 9 aa, Homo Sapiens
QESTAKKIK

SEQ ID NO: 1389977 - protein, 9 aa, Homo Sapiens
CLRMRPPRS

SEQ ID NO: 1389978 - protein, 9 aa, Homo Sapiens
LLPCEAPFC

SEQ ID NO: 1389979 - protein, 9 aa, Homo Sapiens
PTPTEPPLP

SEQ ID NO: 1389980 - protein, 9 aa, Homo Sapiens
PEKKPEEEE

SEQ ID NO: 1389981 - protein, 9 aa, Homo Sapiens
FESKLNNKY

SEQ ID NO: 1389982 - protein, 9 aa, Homo Sapiens
RHRGQHAAG

SEQ ID NO: 1389983 - protein, 9 aa, Homo Sapiens
CKNHDQHLL

SEQ ID NO: 1389984 - protein, 9 aa, Homo Sapiens
LFLRISRPP

SEQ ID NO: 1389985 - protein, 9 aa, Homo Sapiens
CSPSGRWTT

SEQ ID NO: 1389986 - protein, 9 aa, Homo Sapiens
TGVNLGQGH

SEQ ID NO: 1389987 - protein, 9 aa, Homo Sapiens
KPPGAGEEG

SEQ ID NO: 1389988 - protein, 9 aa, Homo Sapiens
IMSQRVCLW

SEQ ID NO: 1389989 - protein, 9 aa, Homo Sapiens
TDEAFYGLD

SEQ ID NO: 1389990 - protein, 9 aa, Homo Sapiens
PAAPGLQWP

SEQ ID NO: 1389991 - protein, 9 aa, Homo Sapiens
IVERIGLAT

SEQ ID NO: 1389992 - protein, 9 aa, Homo Sapiens
NLPGIAHLP

SEQ ID NO: 1389993 - protein, 9 aa, Homo Sapiens
TGPCPAPAP

SEQ ID NO: 1389994 - protein, 9 aa, Homo Sapiens
RQVRCPACC

SEQ ID NO: 1389995 - protein, 9 aa, Homo Sapiens
TQARPRNAG

SEQ ID NO: 1389996 - protein, 9 aa, Homo Sapiens
SPWQVMASL

SEQ ID NO: 1389997 - protein, 9 aa, Homo Sapiens
RVAEPAVAA

SEQ ID NO: 1389998 - protein, 9 aa, Homo Sapiens
VDATGQQDG

SEQ ID NO: 1389999 - protein, 9 aa, Homo Sapiens
LSKENRRPP

SEQ ID NO: 1390000 - protein, 9 aa, Homo Sapiens
WRGLHSFYH

SEQ ID NO: 1390001 - protein, 9 aa, Homo Sapiens
LSEEIIGEI

SEQ ID NO: 1390002 - protein, 9 aa, Homo Sapiens
HWLRPTSGP

SEQ ID NO: 1390003 - protein, 9 aa, Homo Sapiens
QRLLHPPSS

SEQ ID NO: 1390004 - protein, 9 aa, Homo Sapiens
LEGVQTPVL

SEQ ID NO: 1390005 - protein, 9 aa, Homo Sapiens
TAPIPMMPA

SEQ ID NO: 1390006 - protein, 9 aa, Homo Sapiens
YEHQKKLNL

SEQ ID NO: 1390007 - protein, 9 aa, Homo Sapiens
ISAYVRVGK

SEQ ID NO: 1390008 - protein, 9 aa, Homo Sapiens
GVQTPVLFG

SEQ ID NO: 1390009 - protein, 9 aa, Homo Sapiens
KRTQTCTNP

SEQ ID NO: 1390010 - protein, 9 aa, Homo Sapiens
EKERQTEKC

SEQ ID NO: 1390011 - protein, 9 aa, Homo Sapiens
RKISGILEH

SEQ ID NO: 1390012 - protein, 9 aa, Homo Sapiens
PTCVSSTTT

SEQ ID NO: 1390013 - protein, 9 aa, Homo Sapiens
HVRVHPDLG

SEQ ID NO: 1390014 - protein, 9 aa, Homo Sapiens
IGTDVGIVL

SEQ ID NO: 1390015 - protein, 9 aa, Homo Sapiens
VTTIADIVE

SEQ ID NO: 1390016 - protein, 9 aa, Homo Sapiens
QINIDFRTQ

SEQ ID NO: 1390017 - protein, 9 aa, Homo Sapiens
ECFNETIGL

SEQ ID NO: 1390018 - protein, 9 aa, Homo Sapiens
IKDIFLMKR

SEQ ID NO: 1390019 - protein, 9 aa, Homo Sapiens
PLMKPAGHF

SEQ ID NO: 1390020 - protein, 9 aa, Homo Sapiens
MSVLQRVLY

SEQ ID NO: 1390021 - protein, 9 aa, Homo Sapiens
WWMPSLARL

SEQ ID NO: 1390022 - protein, 9 aa, Homo Sapiens
NLVVVEGVH

SEQ ID NO: 1390023 - protein, 9 aa, Homo Sapiens
MRQVRCPAC

SEQ ID NO: 1390024 - protein, 9 aa, Homo Sapiens
QVIETTNVE

SEQ ID NO: 1390025 - protein, 9 aa, Homo Sapiens
FRRDHAAAL

SEQ ID NO: 1390026 - protein, 9 aa, Homo Sapiens
LRMQRFTSP

SEQ ID NO: 1390027 - protein, 9 aa, Homo Sapiens
CTPMYTDVI

SEQ ID NO: 1390028 - protein, 9 aa, Homo Sapiens
SPGRRDPQD

SEQ ID NO: 1390029 - protein, 9 aa, Homo Sapiens
LTSLHPMTD

SEQ ID NO: 1390030 - protein, 9 aa, Homo Sapiens
STSLGWCLT

SEQ ID NO: 1390031 - protein, 9 aa, Homo Sapiens
SHTGRSGSR

SEQ ID NO: 1390032 - protein, 9 aa, Homo Sapiens
DMSNRHVCR

SEQ ID NO: 1390033 - protein, 9 aa, Homo Sapiens
CFVAICNPL

SEQ ID NO: 1390034 - protein, 9 aa, Homo Sapiens
ELPGGLRHA

SEQ ID NO: 1390035 - protein, 9 aa, Homo Sapiens
HPPHTPSHH

SEQ ID NO: 1390036 - protein, 9 aa, Homo Sapiens
GGLQENESS

SEQ ID NO: 1390037 - protein, 9 aa, Homo Sapiens
SMAHSATHS

SEQ ID NO: 1390038 - protein, 9 aa, Homo Sapiens
DRMLQEAER

SEQ ID NO: 1390039 - protein, 9 aa, Homo Sapiens
DTDDDMAMC

SEQ ID NO: 1390040 - protein, 9 aa, Homo Sapiens
KNWVSCCYV

SEQ ID NO: 1390041 - protein, 9 aa, Homo Sapiens
FLKILEGDN

SEQ ID NO: 1390042 - protein, 9 aa, Homo Sapiens
SSLAEEQSE

SEQ ID NO: 1390043 - protein, 9 aa, Homo Sapiens
DASLMGLCV

SEQ ID NO: 1390044 - protein, 9 aa, Homo Sapiens
FMPELVDTH

SEQ ID NO: 1390045 - protein, 9 aa, Homo Sapiens
KRRNLQRNL

SEQ ID NO: 1390046 - protein, 9 aa, Homo Sapiens
TSARVSDLH

SEQ ID NO: 1390047 - protein, 9 aa, Homo Sapiens
TEEAEEDDD

SEQ ID NO: 1390048 - protein, 9 aa, Homo Sapiens
TAWPHLTEG

SEQ ID NO: 1390049 - protein, 9 aa, Homo Sapiens
RLCHGGLSV

SEQ ID NO: 1390050 - protein, 9 aa, Homo Sapiens
LNRMPSVTE

SEQ ID NO: 1390051 - protein, 9 aa, Homo Sapiens
FSPSYLPKQ

SEQ ID NO: 1390052 - protein, 9 aa, Homo Sapiens
YPHFLLQTS

SEQ ID NO: 1390053 - protein, 9 aa, Homo Sapiens
PPAPPAALV

SEQ ID NO: 1390054 - protein, 9 aa, Homo Sapiens
PRGRSQDCD

SEQ ID NO: 1390055 - protein, 9 aa, Homo Sapiens
PMIVGSYLV

SEQ ID NO: 1390056 - protein, 9 aa, Homo Sapiens
AFILLPCEA

SEQ ID NO: 1390057 - protein, 9 aa, Homo Sapiens
TCSPSGRWT

SEQ ID NO: 1390058 - protein, 9 aa, Homo Sapiens
TTPPASPWL

SEQ ID NO: 1390059 - protein, 9 aa, Homo Sapiens
VQSLLAPGK

SEQ ID NO: 1390060 - protein, 9 aa, Homo Sapiens
NTPEQMVPY

SEQ ID NO: 1390061 - protein, 9 aa, Homo Sapiens
EVVAQYQMI

SEQ ID NO: 1390062 - protein, 9 aa, Homo Sapiens
FMKMEFRTS

SEQ ID NO: 1390063 - protein, 9 aa, Homo Sapiens
TWMTCPPWT

SEQ ID NO: 1390064 - protein, 9 aa, Homo Sapiens
LQAIKMGRY

SEQ ID NO: 1390065 - protein, 9 aa, Homo Sapiens
PNEAPPPSW

SEQ ID NO: 1390066 - protein, 9 aa, Homo Sapiens
IILVFTFAS

SEQ ID NO: 1390067 - protein, 9 aa, Homo Sapiens
SPSEEELPN

SEQ ID NO: 1390068 - protein, 9 aa, Homo Sapiens
GRYFLWVVK

SEQ ID NO: 1390069 - protein, 9 aa, Homo Sapiens
CHGGLSVAF

SEQ ID NO: 1390070 - protein, 9 aa, Homo Sapiens
DPQDGCNDG

SEQ ID NO: 1390071 - protein, 9 aa, Homo Sapiens
APAPPEWKC

SEQ ID NO: 1390072 - protein, 9 aa, Homo Sapiens
EPSTPTQYI

SEQ ID NO: 1390073 - protein, 9 aa, Homo Sapiens
DVENSAQGI

SEQ ID NO: 1390074 - protein, 9 aa, Homo Sapiens
SFFFFFLFF

SEQ ID NO: 1390075 - protein, 9 aa, Homo Sapiens
IVIIKDIFL

SEQ ID NO: 1390076 - protein, 9 aa, Homo Sapiens
CFLTTSEEA

SEQ ID NO: 1390077 - protein, 9 aa, Homo Sapiens
KLRVLDRQG

SEQ ID NO: 1390078 - protein, 9 aa, Homo Sapiens
PMMPASQTQ

SEQ ID NO: 1390079 - protein, 9 aa, Homo Sapiens
DIPIHDTIS

SEQ ID NO: 1390080 - protein, 9 aa, Homo Sapiens
AGRPGHRHP

SEQ ID NO: 1390081 - protein, 9 aa, Homo Sapiens
ACRLHAELR

SEQ ID NO: 1390082 - protein, 9 aa, Homo Sapiens
NGAPPECCS

SEQ ID NO: 1390083 - protein, 9 aa, Homo Sapiens
LNNFLKHKL

SEQ ID NO: 1390084 - protein, 9 aa, Homo Sapiens
ENNGGGGAC

SEQ ID NO: 1390085 - protein, 9 aa, Homo Sapiens
AEEGSWSWQ

SEQ ID NO: 1390086 - protein, 9 aa, Homo Sapiens
SLICFHVRF

SEQ ID NO: 1390087 - protein, 9 aa, Homo Sapiens
DPGPGAWTL

SEQ ID NO: 1390088 - protein, 9 aa, Homo Sapiens
SPWLPIPVR

SEQ ID NO: 1390089 - protein, 9 aa, Homo Sapiens
QKVKEQKGK

SEQ ID NO: 1390090 - protein, 9 aa, Homo Sapiens
IFICFIEEC

SEQ ID NO: 1390091 - protein, 9 aa, Homo Sapiens
GEENEKVVL

SEQ ID NO: 1390092 - protein, 9 aa, Homo Sapiens
FLRSGMRDR

SEQ ID NO: 1390093 - protein, 9 aa, Homo Sapiens
KTRSEWQLL

SEQ ID NO: 1390094 - protein, 9 aa, Homo Sapiens
SFSLCNFSC

SEQ ID NO: 1390095 - protein, 9 aa, Homo Sapiens
KCRVNAVEE

SEQ ID NO: 1390096 - protein, 9 aa, Homo Sapiens
EAALSQTGF

SEQ ID NO: 1390097 - protein, 9 aa, Homo Sapiens
ISSSVLVAT

SEQ ID NO: 1390098 - protein, 9 aa, Homo Sapiens
LEASPTTHL

SEQ ID NO: 1390099 - protein, 9 aa, Homo Sapiens
ERGLPPAVL

SEQ ID NO: 1390100 - protein, 9 aa, Homo Sapiens
CASHFCQFH

SEQ ID NO: 1390101 - protein, 9 aa, Homo Sapiens
RNPHFQNKV

SEQ ID NO: 1390102 - protein, 9 aa, Homo Sapiens
GSAEIPTGS

SEQ ID NO: 1390103 - protein, 9 aa, Homo Sapiens
MLVNGKKGA

SEQ ID NO: 1390104 - protein, 9 aa, Homo Sapiens
LEGWMPDQL

SEQ ID NO: 1390105 - protein, 9 aa, Homo Sapiens
TIRKEEDGD

SEQ ID NO: 1390106 - protein, 9 aa, Homo Sapiens
APRLAPLLV

SEQ ID NO: 1390107 - protein, 9 aa, Homo Sapiens
VPLSPCRWL

SEQ ID NO: 1390108 - protein, 9 aa, Homo Sapiens
KLHQLIMNT

SEQ ID NO: 1390109 - protein, 9 aa, Homo Sapiens
HQKFTHFYL

SEQ ID NO: 1390110 - protein, 9 aa, Homo Sapiens
HPAWLSPIS

SEQ ID NO: 1390111 - protein, 9 aa, Homo Sapiens
PGSPGMQGA

SEQ ID NO: 1390112 - protein, 9 aa, Homo Sapiens
PPMDLPGLT

SEQ ID NO: 1390113 - protein, 9 aa, Homo Sapiens
SQRVCLWLS

SEQ ID NO: 1390114 - protein, 9 aa, Homo Sapiens
INAVCADPC

SEQ ID NO: 1390115 - protein, 9 aa, Homo Sapiens
LKITVSDVN

SEQ ID NO: 1390116 - protein, 9 aa, Homo Sapiens
PRSPTRCCR

SEQ ID NO: 1390117 - protein, 9 aa, Homo Sapiens
TGSEADGLD

SEQ ID NO: 1390118 - protein, 9 aa, Homo Sapiens
SQVGVKIVM

SEQ ID NO: 1390119 - protein, 9 aa, Homo Sapiens
PIWHVQQLE

SEQ ID NO: 1390120 - protein, 9 aa, Homo Sapiens
PMDLPGLTR

SEQ ID NO: 1390121 - protein, 9 aa, Homo Sapiens
KIFRKMSSS

SEQ ID NO: 1390122 - protein, 9 aa, Homo Sapiens
ADFHGDHST

SEQ ID NO: 1390123 - protein, 9 aa, Homo Sapiens
GGLSYKEDM

SEQ ID NO: 1390124 - protein, 9 aa, Homo Sapiens
ATSASGAFV

SEQ ID NO: 1390125 - protein, 9 aa, Homo Sapiens
MAQKEMKYE

SEQ ID NO: 1390126 - protein, 9 aa, Homo Sapiens
LLIPECFNE

SEQ ID NO: 1390127 - protein, 9 aa, Homo Sapiens
RSLRPEVGG

SEQ ID NO: 1390128 - protein, 9 aa, Homo Sapiens
LNLLSPHTS

SEQ ID NO: 1390129 - protein, 9 aa, Homo Sapiens
RGQHAAGKD

SEQ ID NO: 1390130 - protein, 9 aa, Homo Sapiens
SNFKVHFFV

SEQ ID NO: 1390131 - protein, 9 aa, Homo Sapiens
NGSLAAEFQ

SEQ ID NO: 1390132 - protein, 9 aa, Homo Sapiens
QNAQVHQLL

SEQ ID NO: 1390133 - protein, 9 aa, Homo Sapiens
LFEVFTIWL

SEQ ID NO: 1390134 - protein, 9 aa, Homo Sapiens
MNQQFRNCI

SEQ ID NO: 1390135 - protein, 9 aa, Homo Sapiens
LWMIVIIKD

SEQ ID NO: 1390136 - protein, 9 aa, Homo Sapiens
GSHCSTSFL

SEQ ID NO: 1390137 - protein, 9 aa, Homo Sapiens
FRAGPTPSS

SEQ ID NO: 1390138 - protein, 9 aa, Homo Sapiens
CWWTMGLRP

SEQ ID NO: 1390139 - protein, 9 aa, Homo Sapiens
ATRTSPAPW

SEQ ID NO: 1390140 - protein, 9 aa, Homo Sapiens
HVAADMMVD

SEQ ID NO: 1390141 - protein, 9 aa, Homo Sapiens
FYLDQWTPT

SEQ ID NO: 1390142 - protein, 9 aa, Homo Sapiens
KDIFLMKRF

SEQ ID NO: 1390143 - protein, 9 aa, Homo Sapiens
RMPGPPWPT

SEQ ID NO: 1390144 - protein, 9 aa, Homo Sapiens
NSMLTDSGN

SEQ ID NO: 1390145 - protein, 9 aa, Homo Sapiens
QLLCLINYY

SEQ ID NO: 1390146 - protein, 9 aa, Homo Sapiens
MLMAGSVSA

SEQ ID NO: 1390147 - protein, 9 aa, Homo Sapiens
RSQDCDQVC

SEQ ID NO: 1390148 - protein, 9 aa, Homo Sapiens
EFLQLAEPL

SEQ ID NO: 1390149 - protein, 9 aa, Homo Sapiens
REIQNSLLH

SEQ ID NO: 1390150 - protein, 9 aa, Homo Sapiens
SLAAEFQHL

SEQ ID NO: 1390151 - protein, 9 aa, Homo Sapiens
LRLIIPVEL

SEQ ID NO: 1390152 - protein, 9 aa, Homo Sapiens
HRFLCFSSE

SEQ ID NO: 1390153 - protein, 9 aa, Homo Sapiens
VEELHSRRM

SEQ ID NO: 1390154 - protein, 9 aa, Homo Sapiens
GLEENLLGI

SEQ ID NO: 1390155 - protein, 9 aa, Homo Sapiens
NMMNKMRDN

SEQ ID NO: 1390156 - protein, 9 aa, Homo Sapiens
RTTEPVIPK

SEQ ID NO: 1390157 - protein, 9 aa, Homo Sapiens
AVVVGTITE

SEQ ID NO: 1390158 - protein, 9 aa, Homo Sapiens
PPYFPLKIP

SEQ ID NO: 1390159 - protein, 9 aa, Homo Sapiens
KSSNILILE

SEQ ID NO: 1390160 - protein, 9 aa, Homo Sapiens
PPATTAETQ

SEQ ID NO: 1390161 - protein, 9 aa, Homo Sapiens
DVAHLACPE

SEQ ID NO: 1390162 - protein, 9 aa, Homo Sapiens
THIYIHTHT

SEQ ID NO: 1390163 - protein, 9 aa, Homo Sapiens
GPDAVAVPF

SEQ ID NO: 1390164 - protein, 9 aa, Homo Sapiens
TQDVQMKGE

SEQ ID NO: 1390165 - protein, 9 aa, Homo Sapiens
LGLETQKHW

SEQ ID NO: 1390166 - protein, 9 aa, Homo Sapiens
PSTRAAPPS

SEQ ID NO: 1390167 - protein, 9 aa, Homo Sapiens
DLFRIVFQI

SEQ ID NO: 1390168 - protein, 9 aa, Homo Sapiens
LTGTHPRKV

SEQ ID NO: 1390169 - protein, 9 aa, Homo Sapiens
NALWVAALE

SEQ ID NO: 1390170 - protein, 9 aa, Homo Sapiens
QAISARSWP

SEQ ID NO: 1390171 - protein, 9 aa, Homo Sapiens
QSGRPGGED

SEQ ID NO: 1390172 - protein, 9 aa, Homo Sapiens
LEVNLSFFG

SEQ ID NO: 1390173 - protein, 9 aa, Homo Sapiens
PSNRSLPHA

SEQ ID NO: 1390174 - protein, 9 aa, Homo Sapiens
IWKNTRVEN

SEQ ID NO: 1390175 - protein, 9 aa, Homo Sapiens
LGPKSRGPA

SEQ ID NO: 1390176 - protein, 9 aa, Homo Sapiens
KKKTRTSLH

SEQ ID NO: 1390177 - protein, 9 aa, Homo Sapiens
SAVSSLKKQ

SEQ ID NO: 1390178 - protein, 9 aa, Homo Sapiens
LQKFKQAKR

SEQ ID NO: 1390179 - protein, 9 aa, Homo Sapiens
CFIEECSFV

SEQ ID NO: 1390180 - protein, 9 aa, Homo Sapiens
LECMLKKTS

SEQ ID NO: 1390181 - protein, 9 aa, Homo Sapiens
LTRARGPPS

SEQ ID NO: 1390182 - protein, 9 aa, Homo Sapiens
NNKYLRQSN

SEQ ID NO: 1390183 - protein, 9 aa, Homo Sapiens
HFPLYWFSV

SEQ ID NO: 1390184 - protein, 9 aa, Homo Sapiens
QPDLRGRGV

SEQ ID NO: 1390185 - protein, 9 aa, Homo Sapiens
LKVLILQRK

SEQ ID NO: 1390186 - protein, 9 aa, Homo Sapiens
DSTKSFAIK

SEQ ID NO: 1390187 - protein, 9 aa, Homo Sapiens
EVSPSARWQ

SEQ ID NO: 1390188 - protein, 9 aa, Homo Sapiens
VIVERIGLA

SEQ ID NO: 1390189 - protein, 9 aa, Homo Sapiens
CRCTTPPAS

SEQ ID NO: 1390190 - protein, 9 aa, Homo Sapiens
LSDRPSVSI

SEQ ID NO: 1390191 - protein, 9 aa, Homo Sapiens
LKKNISSGS

SEQ ID NO: 1390192 - protein, 9 aa, Homo Sapiens
VMFISDDES

SEQ ID NO: 1390193 - protein, 9 aa, Homo Sapiens
RIPSAPWMP

SEQ ID NO: 1390194 - protein, 9 aa, Homo Sapiens
DINDHYPMF

SEQ ID NO: 1390195 - protein, 9 aa, Homo Sapiens
LKKKTRTSL

SEQ ID NO: 1390196 - protein, 9 aa, Homo Sapiens
SWRRSGTLG

SEQ ID NO: 1390197 - protein, 9 aa, Homo Sapiens
KDGRLAGRL

SEQ ID NO: 1390198 - protein, 9 aa, Homo Sapiens
QPPSPSSLL

SEQ ID NO: 1390199 - protein, 9 aa, Homo Sapiens
WLSWRRSGT

SEQ ID NO: 1390200 - protein, 9 aa, Homo Sapiens
GATGRRQSR

SEQ ID NO: 1390201 - protein, 9 aa, Homo Sapiens
TITEDVRVQ

SEQ ID NO: 1390202 - protein, 9 aa, Homo Sapiens
GKRSHLWTL

SEQ ID NO: 1390203 - protein, 9 aa, Homo Sapiens
KSANLWGKF

SEQ ID NO: 1390204 - protein, 9 aa, Homo Sapiens
LTSRILDAK

SEQ ID NO: 1390205 - protein, 9 aa, Homo Sapiens
RASLSTLGD

SEQ ID NO: 1390206 - protein, 9 aa, Homo Sapiens
ERTATEEKA

SEQ ID NO: 1390207 - protein, 9 aa, Homo Sapiens
CGLGSSCCG

SEQ ID NO: 1390208 - protein, 9 aa, Homo Sapiens
TVKLLDYTK

SEQ ID NO: 1390209 - protein, 9 aa, Homo Sapiens
AFDCFVAIC

SEQ ID NO: 1390210 - protein, 9 aa, Homo Sapiens
SMQMRRRSQ

SEQ ID NO: 1390211 - protein, 9 aa, Homo Sapiens
VRSINHANL

SEQ ID NO: 1390212 - protein, 9 aa, Homo Sapiens
QALKNSFEG

SEQ ID NO: 1390213 - protein, 9 aa, Homo Sapiens
PHTSYREEE

SEQ ID NO: 1390214 - protein, 9 aa, Homo Sapiens
FSPGIGSLL

SEQ ID NO: 1390215 - protein, 9 aa, Homo Sapiens
WLSWRRSRT

SEQ ID NO: 1390216 - protein, 9 aa, Homo Sapiens
DIPASHSDV

SEQ ID NO: 1390217 - protein, 9 aa, Homo Sapiens
DEEYLSPQR

SEQ ID NO: 1390218 - protein, 9 aa, Homo Sapiens
CIHDIRRSK

SEQ ID NO: 1390219 - protein, 9 aa, Homo Sapiens
EFRTSMKSS

SEQ ID NO: 1390220 - protein, 9 aa, Homo Sapiens
CIGEESGGV

SEQ ID NO: 1390221 - protein, 9 aa, Homo Sapiens
VTSETSYYK

SEQ ID NO: 1390222 - protein, 9 aa, Homo Sapiens
LCSHRGLSS

SEQ ID NO: 1390223 - protein, 9 aa, Homo Sapiens
KRPQNPSNR

SEQ ID NO: 1390224 - protein, 9 aa, Homo Sapiens
WTTTSCMWL

SEQ ID NO: 1390225 - protein, 9 aa, Homo Sapiens
LYPGFTKHL

SEQ ID NO: 1390226 - protein, 9 aa, Homo Sapiens
SLSTLGDVY

SEQ ID NO: 1390227 - protein, 9 aa, Homo Sapiens
WRWGTLRFV

SEQ ID NO: 1390228 - protein, 9 aa, Homo Sapiens
NRHVCRHFM

SEQ ID NO: 1390229 - protein, 9 aa, Homo Sapiens
VRDCLPTDV

SEQ ID NO: 1390230 - protein, 9 aa, Homo Sapiens
TLTTHKNSY

SEQ ID NO: 1390231 - protein, 9 aa, Homo Sapiens
PPSTQVEQL

SEQ ID NO: 1390232 - protein, 9 aa, Homo Sapiens
EEEENQMAG

SEQ ID NO: 1390233 - protein, 9 aa, Homo Sapiens
QLLLLDANK

SEQ ID NO: 1390234 - protein, 9 aa, Homo Sapiens
FSLCNFSCF

SEQ ID NO: 1390235 - protein, 9 aa, Homo Sapiens
ARVGTWLTA

SEQ ID NO: 1390236 - protein, 9 aa, Homo Sapiens
LTCFNQTYT

SEQ ID NO: 1390237 - protein, 9 aa, Homo Sapiens
KRKEWQRQP

SEQ ID NO: 1390238 - protein, 9 aa, Homo Sapiens
CDKIKQFAA

SEQ ID NO: 1390239 - protein, 9 aa, Homo Sapiens
DVDTINHPA

SEQ ID NO: 1390240 - protein, 9 aa, Homo Sapiens
WSPSTQTTA

SEQ ID NO: 1390241 - protein, 9 aa, Homo Sapiens
FGHGLHRHR

SEQ ID NO: 1390242 - protein, 9 aa, Homo Sapiens
VAFSPSYLP

SEQ ID NO: 1390243 - protein, 9 aa, Homo Sapiens
KIPDKEVRQ

SEQ ID NO: 1390244 - protein, 9 aa, Homo Sapiens
WEVPFADLS

SEQ ID NO: 1390245 - protein, 9 aa, Homo Sapiens
EEMKRRISS

SEQ ID NO: 1390246 - protein, 9 aa, Homo Sapiens
GPGKPTLSK

SEQ ID NO: 1390247 - protein, 9 aa, Homo Sapiens
SSVQKKMKI

SEQ ID NO: 1390248 - protein, 9 aa, Homo Sapiens
TRTSLHQAT

SEQ ID NO: 1390249 - protein, 9 aa, Homo Sapiens
SIPNLKSVD

SEQ ID NO: 1390250 - protein, 9 aa, Homo Sapiens
DPHLCLLAP

SEQ ID NO: 1390251 - protein, 9 aa, Homo Sapiens
WTFSPRVTR

SEQ ID NO: 1390252 - protein, 9 aa, Homo Sapiens
MFQKSSTSP

SEQ ID NO: 1390253 - protein, 9 aa, Homo Sapiens
TEPPLPTAS

SEQ ID NO: 1390254 - protein, 9 aa, Homo Sapiens
LVLDVSSIS

SEQ ID NO: 1390255 - protein, 9 aa, Homo Sapiens
PKVTLGWGP

SEQ ID NO: 1390256 - protein, 9 aa, Homo Sapiens
PQKNVKVKK

SEQ ID NO: 1390257 - protein, 9 aa, Homo Sapiens
DLGSGDLGN

SEQ ID NO: 1390258 - protein, 9 aa, Homo Sapiens
IPNINFQCA

SEQ ID NO: 1390259 - protein, 9 aa, Homo Sapiens
ETQKHWASC

SEQ ID NO: 1390260 - protein, 9 aa, Homo Sapiens
EDDVEIGMW

SEQ ID NO: 1390261 - protein, 9 aa, Homo Sapiens
GPPPQGKPQ

SEQ ID NO: 1390262 - protein, 9 aa, Homo Sapiens
WEIRLAQER

SEQ ID NO: 1390263 - protein, 9 aa, Homo Sapiens
IRGALTTRP

SEQ ID NO: 1390264 - protein, 9 aa, Homo Sapiens
NTRSSLAEE

SEQ ID NO: 1390265 - protein, 9 aa, Homo Sapiens
GSIISTQVS

SEQ ID NO: 1390266 - protein, 9 aa, Homo Sapiens
EGDSWRSLL

SEQ ID NO: 1390267 - protein, 9 aa, Homo Sapiens
APFLRGLWC

SEQ ID NO: 1390268 - protein, 9 aa, Homo Sapiens
NHANLISAL

SEQ ID NO: 1390269 - protein, 9 aa, Homo Sapiens
NVRRILINL

SEQ ID NO: 1390270 - protein, 9 aa, Homo Sapiens
AYADDVENS

SEQ ID NO: 1390271 - protein, 9 aa, Homo Sapiens
FLYNRRLKS

SEQ ID NO: 1390272 - protein, 9 aa, Homo Sapiens
LDVDTINHP

SEQ ID NO: 1390273 - protein, 9 aa, Homo Sapiens
FFTSAHPSR

SEQ ID NO: 1390274 - protein, 9 aa, Homo Sapiens
GIPKPLGPK

SEQ ID NO: 1390275 - protein, 9 aa, Homo Sapiens
KHLQPEFKT

SEQ ID NO: 1390276 - protein, 9 aa, Homo Sapiens
LRISRPPVT

SEQ ID NO: 1390277 - protein, 9 aa, Homo Sapiens
TCPGEQLRN

SEQ ID NO: 1390278 - protein, 9 aa, Homo Sapiens
KMTGKIILV

SEQ ID NO: 1390279 - protein, 9 aa, Homo Sapiens
NKINKITDE

SEQ ID NO: 1390280 - protein, 9 aa, Homo Sapiens
TWATKGRPR

SEQ ID NO: 1390281 - protein, 9 aa, Homo Sapiens
PMTSHMNSV

SEQ ID NO: 1390282 - protein, 9 aa, Homo Sapiens
APESLEASP

SEQ ID NO: 1390283 - protein, 9 aa, Homo Sapiens
LVIALKSSM

SEQ ID NO: 1390284 - protein, 9 aa, Homo Sapiens
VSLQLLLLD

SEQ ID NO: 1390285 - protein, 9 aa, Homo Sapiens
SASGAFVPP

SEQ ID NO: 1390286 - protein, 9 aa, Homo Sapiens
KSDGIWKVW

SEQ ID NO: 1390287 - protein, 9 aa, Homo Sapiens
GGVLPCTLL

SEQ ID NO: 1390288 - protein, 9 aa, Homo Sapiens
NHLYHWHPS

SEQ ID NO: 1390289 - protein, 9 aa, Homo Sapiens
CQDIPASHS

SEQ ID NO: 1390290 - protein, 9 aa, Homo Sapiens
ARLSARMTV

SEQ ID NO: 1390291 - protein, 9 aa, Homo Sapiens
SLLSFRDGK

SEQ ID NO: 1390292 - protein, 9 aa, Homo Sapiens
RNSYLALAT

SEQ ID NO: 1390293 - protein, 9 aa, Homo Sapiens
WTLRMQRFT

SEQ ID NO: 1390294 - protein, 9 aa, Homo Sapiens
CNASIMCPL

SEQ ID NO: 1390295 - protein, 9 aa, Homo Sapiens
SALDRCRGK

SEQ ID NO: 1390296 - protein, 9 aa, Homo Sapiens
SCIKWLRKC

SEQ ID NO: 1390297 - protein, 9 aa, Homo Sapiens
CVQQPPYFP

SEQ ID NO: 1390298 - protein, 9 aa, Homo Sapiens
LDRQGWGWG

SEQ ID NO: 1390299 - protein, 9 aa, Homo Sapiens
NIKSVCSRE

SEQ ID NO: 1390300 - protein, 9 aa, Homo Sapiens
TPPCWWTMG

SEQ ID NO: 1390301 - protein, 9 aa, Homo Sapiens
RGEEEAAEA

SEQ ID NO: 1390302 - protein, 9 aa, Homo Sapiens
AVLGAGVHG

SEQ ID NO: 1390303 - protein, 9 aa, Homo Sapiens
LTPLRTPLT

SEQ ID NO: 1390304 - protein, 9 aa, Homo Sapiens
PTPRSPTRC

SEQ ID NO: 1390305 - protein, 9 aa, Homo Sapiens
IKWICSMKM

SEQ ID NO: 1390306 - protein, 9 aa, Homo Sapiens
SVACSYLSL

SEQ ID NO: 1390307 - protein, 9 aa, Homo Sapiens
IKPANMFIT

SEQ ID NO: 1390308 - protein, 9 aa, Homo Sapiens
YSMDLFSSC

SEQ ID NO: 1390309 - protein, 9 aa, Homo Sapiens
FSSEGGTYY

SEQ ID NO: 1390310 - protein, 9 aa, Homo Sapiens
WTRQRIFIT

SEQ ID NO: 1390311 - protein, 9 aa, Homo Sapiens
SGRALPLQL

SEQ ID NO: 1390312 - protein, 9 aa, Homo Sapiens
GHKSALLGK

SEQ ID NO: 1390313 - protein, 9 aa, Homo Sapiens
IQDKHLVDE

SEQ ID NO: 1390314 - protein, 9 aa, Homo Sapiens
PQPQPDPHL

SEQ ID NO: 1390315 - protein, 9 aa, Homo Sapiens
EDWKCVLRT

SEQ ID NO: 1390316 - protein, 9 aa, Homo Sapiens
TRWWRGNTR

SEQ ID NO: 1390317 - protein, 9 aa, Homo Sapiens
KGVQSATVQ

SEQ ID NO: 1390318 - protein, 9 aa, Homo Sapiens
GKKKPYECT

SEQ ID NO: 1390319 - protein, 9 aa, Homo Sapiens
QHLQLKEQK

SEQ ID NO: 1390320 - protein, 9 aa, Homo Sapiens
TRTCPSPPW

SEQ ID NO: 1390321 - protein, 9 aa, Homo Sapiens
ECRTTEPVI

SEQ ID NO: 1390322 - protein, 9 aa, Homo Sapiens
VLVMVNGVQ

SEQ ID NO: 1390323 - protein, 9 aa, Homo Sapiens
EGEAKRWEP

SEQ ID NO: 1390324 - protein, 9 aa, Homo Sapiens
VSISENAPV

SEQ ID NO: 1390325 - protein, 9 aa, Homo Sapiens
DSSSNSSSD

SEQ ID NO: 1390326 - protein, 9 aa, Homo Sapiens
CFNETIGLQ

SEQ ID NO: 1390327 - protein, 9 aa, Homo Sapiens
CRLHAELRA

SEQ ID NO: 1390328 - protein, 9 aa, Homo Sapiens
LKLQRGIYL

SEQ ID NO: 1390329 - protein, 9 aa, Homo Sapiens
HRGQHAAGK

SEQ ID NO: 1390330 - protein, 9 aa, Homo Sapiens
MRVLDANDN

SEQ ID NO: 1390331 - protein, 9 aa, Homo Sapiens
SPSGRWTTR

SEQ ID NO: 1390332 - protein, 9 aa, Homo Sapiens
ARAPHVCQD

SEQ ID NO: 1390333 - protein, 9 aa, Homo Sapiens
MLEWRLGFL

SEQ ID NO: 1390334 - protein, 9 aa, Homo Sapiens
PAMKHYLLY

SEQ ID NO: 1390335 - protein, 9 aa, Homo Sapiens
RIGREVATQ

SEQ ID NO: 1390336 - protein, 9 aa, Homo Sapiens
SHGGRRRRS

SEQ ID NO: 1390337 - protein, 9 aa, Homo Sapiens
LKKKPLHQA

SEQ ID NO: 1390338 - protein, 9 aa, Homo Sapiens
PFRRGTGVN

SEQ ID NO: 1390339 - protein, 9 aa, Homo Sapiens
TSRYNDGRC

SEQ ID NO: 1390340 - protein, 9 aa, Homo Sapiens
SLEASPTTH

SEQ ID NO: 1390341 - protein, 9 aa, Homo Sapiens
ISENAPVGT

SEQ ID NO: 1390342 - protein, 9 aa, Homo Sapiens
CSPSMSTAR

SEQ ID NO: 1390343 - protein, 9 aa, Homo Sapiens
KPTDTFLQI

SEQ ID NO: 1390344 - protein, 9 aa, Homo Sapiens
INDHYPMFT

SEQ ID NO: 1390345 - protein, 9 aa, Homo Sapiens
VLEGWMPDQ

SEQ ID NO: 1390346 - protein, 9 aa, Homo Sapiens
PERGLPPAV

SEQ ID NO: 1390347 - protein, 9 aa, Homo Sapiens
HIFKYPSIQ

SEQ ID NO: 1390348 - protein, 9 aa, Homo Sapiens
EEHFGPDAV

SEQ ID NO: 1390349 - protein, 9 aa, Homo Sapiens
HISQAMRYL

SEQ ID NO: 1390350 - protein, 9 aa, Homo Sapiens
KNGQVWASA

SEQ ID NO: 1390351 - protein, 9 aa, Homo Sapiens
PLESSKNAE

SEQ ID NO: 1390352 - protein, 9 aa, Homo Sapiens
FVASLWGWS

SEQ ID NO: 1390353 - protein, 9 aa, Homo Sapiens
SSVLQGHVY

SEQ ID NO: 1390354 - protein, 9 aa, Homo Sapiens
LVHEALQLC

SEQ ID NO: 1390355 - protein, 9 aa, Homo Sapiens
HNLTEGSLH

SEQ ID NO: 1390356 - protein, 9 aa, Homo Sapiens
SWPVAQRMG

SEQ ID NO: 1390357 - protein, 9 aa, Homo Sapiens
ACPRLLPYP

SEQ ID NO: 1390358 - protein, 9 aa, Homo Sapiens
TRSEWQLLR

SEQ ID NO: 1390359 - protein, 9 aa, Homo Sapiens
AWSRLRGPG

SEQ ID NO: 1390360 - protein, 9 aa, Homo Sapiens
VDQRHRARQ

SEQ ID NO: 1390361 - protein, 9 aa, Homo Sapiens
EQKNSSRAD

SEQ ID NO: 1390362 - protein, 9 aa, Homo Sapiens
GRGVARSEG

SEQ ID NO: 1390363 - protein, 9 aa, Homo Sapiens
IPMTSHMNS

SEQ ID NO: 1390364 - protein, 9 aa, Homo Sapiens
CKHRKRSRS

SEQ ID NO: 1390365 - protein, 9 aa, Homo Sapiens
HKQAKACPI

SEQ ID NO: 1390366 - protein, 9 aa, Homo Sapiens
KRMHSSERP

SEQ ID NO: 1390367 - protein, 9 aa, Homo Sapiens
EKDQDKEKE

SEQ ID NO: 1390368 - protein, 9 aa, Homo Sapiens
RHVLDGLHN

SEQ ID NO: 1390369 - protein, 9 aa, Homo Sapiens
SSESHKLFS

SEQ ID NO: 1390370 - protein, 9 aa, Homo Sapiens
STWAPVTST

SEQ ID NO: 1390371 - protein, 9 aa, Homo Sapiens
LRPTSGPAT

SEQ ID NO: 1390372 - protein, 9 aa, Homo Sapiens
SQMDQQGQG

SEQ ID NO: 1390373 - protein, 9 aa, Homo Sapiens
PASKKCRVN

SEQ ID NO: 1390374 - protein, 9 aa, Homo Sapiens
AVKSSTCPG

SEQ ID NO: 1390375 - protein, 9 aa, Homo Sapiens
TAAPPTHAR

SEQ ID NO: 1390376 - protein, 9 aa, Homo Sapiens
TSIREKPQE

SEQ ID NO: 1390377 - protein, 9 aa, Homo Sapiens
GVNPAVRSP

SEQ ID NO: 1390378 - protein, 9 aa, Homo Sapiens
DDDDEKRGS

SEQ ID NO: 1390379 - protein, 9 aa, Homo Sapiens
VPELLVGRL

SEQ ID NO: 1390380 - protein, 9 aa, Homo Sapiens
KLLPLYFAV

SEQ ID NO: 1390381 - protein, 9 aa, Homo Sapiens
EGQYKHMHR

SEQ ID NO: 1390382 - protein, 9 aa, Homo Sapiens
QMILTPIEA

SEQ ID NO: 1390383 - protein, 9 aa, Homo Sapiens
VGHQASPTK

SEQ ID NO: 1390384 - protein, 9 aa, Homo Sapiens
QKTAIPTVL

SEQ ID NO: 1390385 - protein, 9 aa, Homo Sapiens
EPFTMHSDR

SEQ ID NO: 1390386 - protein, 9 aa, Homo Sapiens
KITVSDVND

SEQ ID NO: 1390387 - protein, 9 aa, Homo Sapiens
QPPYFPLKI

SEQ ID NO: 1390388 - protein, 9 aa, Homo Sapiens
KYLRQSNQS

SEQ ID NO: 1390389 - protein, 9 aa, Homo Sapiens
DKKRRNLQR

SEQ ID NO: 1390390 - protein, 9 aa, Homo Sapiens
SRTSGLVVS

SEQ ID NO: 1390391 - protein, 9 aa, Homo Sapiens
RVDQRHRAR

SEQ ID NO: 1390392 - protein, 9 aa, Homo Sapiens
HPSMHILSS

SEQ ID NO: 1390393 - protein, 9 aa, Homo Sapiens
CSIAMDATL

SEQ ID NO: 1390394 - protein, 9 aa, Homo Sapiens
PHFQNKVLI

SEQ ID NO: 1390395 - protein, 9 aa, Homo Sapiens
DFKMEEKMK

SEQ ID NO: 1390396 - protein, 9 aa, Homo Sapiens
LPIPVRPMG

SEQ ID NO: 1390397 - protein, 9 aa, Homo Sapiens
HFTDEENRD

SEQ ID NO: 1390398 - protein, 9 aa, Homo Sapiens
SSEGGTYYI

SEQ ID NO: 1390399 - protein, 9 aa, Homo Sapiens
LKMCPLWRS

SEQ ID NO: 1390400 - protein, 9 aa, Homo Sapiens
RSLQNLYLL

SEQ ID NO: 1390401 - protein, 9 aa, Homo Sapiens
EREYIHQGK

SEQ ID NO: 1390402 - protein, 9 aa, Homo Sapiens
KMRNPTFNE

SEQ ID NO: 1390403 - protein, 9 aa, Homo Sapiens
KKMVTSKLP

SEQ ID NO: 1390404 - protein, 9 aa, Homo Sapiens
PPHCSPARE

SEQ ID NO: 1390405 - protein, 9 aa, Homo Sapiens
CGHELPGGL

SEQ ID NO: 1390406 - protein, 9 aa, Homo Sapiens
IVLKVVSIP

SEQ ID NO: 1390407 - protein, 9 aa, Homo Sapiens
LVWPERGLP

SEQ ID NO: 1390408 - protein, 9 aa, Homo Sapiens
DPCFIFNNE

SEQ ID NO: 1390409 - protein, 9 aa, Homo Sapiens
SFLLTIMGY

SEQ ID NO: 1390410 - protein, 9 aa, Homo Sapiens
GSCKVFKRA

SEQ ID NO: 1390411 - protein, 9 aa, Homo Sapiens
VESSYRSSQ

SEQ ID NO: 1390412 - protein, 9 aa, Homo Sapiens
ISARSWPTA

SEQ ID NO: 1390413 - protein, 9 aa, Homo Sapiens
TTTGPCPAP

SEQ ID NO: 1390414 - protein, 9 aa, Homo Sapiens
VVDENAVTK

SEQ ID NO: 1390415 - protein, 9 aa, Homo Sapiens
FCQFHYSMD

SEQ ID NO: 1390416 - protein, 9 aa, Homo Sapiens
YLEYNFFEM

SEQ ID NO: 1390417 - protein, 9 aa, Homo Sapiens
PLPTASGLK

SEQ ID NO: 1390418 - protein, 9 aa, Homo Sapiens
EEDWKCVLR

SEQ ID NO: 1390419 - protein, 9 aa, Homo Sapiens
TSLFSNIES

SEQ ID NO: 1390420 - protein, 9 aa, Homo Sapiens
LHQGQVLPG

SEQ ID NO: 1390421 - protein, 9 aa, Homo Sapiens
ITDHVSDSF

SEQ ID NO: 1390422 - protein, 9 aa, Homo Sapiens
VHHCSSRKQ

SEQ ID NO: 1390423 - protein, 9 aa, Homo Sapiens
LPQEQKQAP

SEQ ID NO: 1390424 - protein, 9 aa, Homo Sapiens
GSTTPGLEH

SEQ ID NO: 1390425 - protein, 9 aa, Homo Sapiens
AFFTFSLIV

SEQ ID NO: 1390426 - protein, 9 aa, Homo Sapiens
REASTWAPV

SEQ ID NO: 1390427 - protein, 9 aa, Homo Sapiens
GSSWYIQGC

SEQ ID NO: 1390428 - protein, 9 aa, Homo Sapiens
PGLGAAQLL

SEQ ID NO: 1390429 - protein, 9 aa, Homo Sapiens
GAESMTEEK

SEQ ID NO: 1390430 - protein, 9 aa, Homo Sapiens
CLPTDVECS

SEQ ID NO: 1390431 - protein, 9 aa, Homo Sapiens
VRPMGARAP

SEQ ID NO: 1390432 - protein, 9 aa, Homo Sapiens
HTPSHHPAP

SEQ ID NO: 1390433 - protein, 9 aa, Homo Sapiens
TSTPDCTPM

SEQ ID NO: 1390434 - protein, 9 aa, Homo Sapiens
PGDRGLQGP

SEQ ID NO: 1390435 - protein, 9 aa, Homo Sapiens
CLPPEPGDP

SEQ ID NO: 1390436 - protein, 9 aa, Homo Sapiens
EMYNSTQGM

SEQ ID NO: 1390437 - protein, 9 aa, Homo Sapiens
RNLLRLQSL

SEQ ID NO: 1390438 - protein, 9 aa, Homo Sapiens
TISCPFQSP

SEQ ID NO: 1390439 - protein, 9 aa, Homo Sapiens
EEENQMAGR

SEQ ID NO: 1390440 - protein, 9 aa, Homo Sapiens
GSARVGTWL

SEQ ID NO: 1390441 - protein, 9 aa, Homo Sapiens
LTYSVKQDS

SEQ ID NO: 1390442 - protein, 9 aa, Homo Sapiens
YYSTIMSQR

SEQ ID NO: 1390443 - protein, 9 aa, Homo Sapiens
DPESKQTAP

SEQ ID NO: 1390444 - protein, 9 aa, Homo Sapiens
RDTIPNINF

SEQ ID NO: 1390445 - protein, 9 aa, Homo Sapiens
FPKNLVACP

SEQ ID NO: 1390446 - protein, 9 aa, Homo Sapiens
GIRGALTTR

SEQ ID NO: 1390447 - protein, 9 aa, Homo Sapiens
SPQRSSQSL

SEQ ID NO: 1390448 - protein, 9 aa, Homo Sapiens
RPPVTANIT

SEQ ID NO: 1390449 - protein, 9 aa, Homo Sapiens
PSPARAAAL

SEQ ID NO: 1390450 - protein, 9 aa, Homo Sapiens
GIWKVWQRR

SEQ ID NO: 1390451 - protein, 9 aa, Homo Sapiens
LEEPPRLHS

SEQ ID NO: 1390452 - protein, 9 aa, Homo Sapiens
CSWLFQHLM

SEQ ID NO: 1390453 - protein, 9 aa, Homo Sapiens
RQHSLGPSL

SEQ ID NO: 1390454 - protein, 9 aa, Homo Sapiens
ENAVTKIDA

SEQ ID NO: 1390455 - protein, 9 aa, Homo Sapiens
GLVVSLWGW

SEQ ID NO: 1390456 - protein, 9 aa, Homo Sapiens
QETKKKRNR

SEQ ID NO: 1390457 - protein, 9 aa, Homo Sapiens
PKAQPTLPL

SEQ ID NO: 1390458 - protein, 9 aa, Homo Sapiens
VIMEMLRSI

SEQ ID NO: 1390459 - protein, 9 aa, Homo Sapiens
HLVLTASDD

SEQ ID NO: 1390460 - protein, 9 aa, Homo Sapiens
PKKICVRSA

SEQ ID NO: 1390461 - protein, 9 aa, Homo Sapiens
EALSEGLFQ

SEQ ID NO: 1390462 - protein, 9 aa, Homo Sapiens
DMRGLRLII

SEQ ID NO: 1390463 - protein, 9 aa, Homo Sapiens
QPKKKATKL

SEQ ID NO: 1390464 - protein, 9 aa, Homo Sapiens
EEGSWSWQV

SEQ ID NO: 1390465 - protein, 9 aa, Homo Sapiens
PQSFFFFFL

SEQ ID NO: 1390466 - protein, 9 aa, Homo Sapiens
NNHCQMSGT

SEQ ID NO: 1390467 - protein, 9 aa, Homo Sapiens
WKRPMGLSR

SEQ ID NO: 1390468 - protein, 9 aa, Homo Sapiens
RKEEDGDAG

SEQ ID NO: 1390469 - protein, 9 aa, Homo Sapiens
CAFVVSQVP

SEQ ID NO: 1390470 - protein, 9 aa, Homo Sapiens
NLWGKFLVS

SEQ ID NO: 1390471 - protein, 9 aa, Homo Sapiens
MVGHLASDF

SEQ ID NO: 1390472 - protein, 9 aa, Homo Sapiens
EPLESSKNA

SEQ ID NO: 1390473 - protein, 9 aa, Homo Sapiens
NAKKMVTSK

SEQ ID NO: 1390474 - protein, 9 aa, Homo Sapiens
RLHRFLCFS

SEQ ID NO: 1390475 - protein, 9 aa, Homo Sapiens
APRGLHKRK

SEQ ID NO: 1390476 - protein, 9 aa, Homo Sapiens
STDLKIRGK

SEQ ID NO: 1390477 - protein, 9 aa, Homo Sapiens
GETPGAVHL

SEQ ID NO: 1390478 - protein, 9 aa, Homo Sapiens
WGVGGVEAE

SEQ ID NO: 1390479 - protein, 9 aa, Homo Sapiens
FLHKLILDH

SEQ ID NO: 1390480 - protein, 9 aa, Homo Sapiens
HKLMSFEDF

SEQ ID NO: 1390481 - protein, 9 aa, Homo Sapiens
FFSPGIGSL

SEQ ID NO: 1390482 - protein, 9 aa, Homo Sapiens
PMAANRTPT

SEQ ID NO: 1390483 - protein, 9 aa, Homo Sapiens
EVVLQNLFP

SEQ ID NO: 1390484 - protein, 9 aa, Homo Sapiens
IGVTNHCDG

SEQ ID NO: 1390485 - protein, 9 aa, Homo Sapiens
NSVTLAVNM

SEQ ID NO: 1390486 - protein, 9 aa, Homo Sapiens
KINDPWKNP

SEQ ID NO: 1390487 - protein, 9 aa, Homo Sapiens
WTDIFKRFN

SEQ ID NO: 1390488 - protein, 9 aa, Homo Sapiens
HTFLPKIFR

SEQ ID NO: 1390489 - protein, 9 aa, Homo Sapiens
KEPTKLLKN

SEQ ID NO: 1390490 - protein, 9 aa, Homo Sapiens
HQPAAPGLQ

SEQ ID NO: 1390491 - protein, 9 aa, Homo Sapiens
LMDDIGSEV

SEQ ID NO: 1390492 - protein, 9 aa, Homo Sapiens
PRKGQKFGL

SEQ ID NO: 1390493 - protein, 9 aa, Homo Sapiens
GRRWGAWHP

SEQ ID NO: 1390494 - protein, 9 aa, Homo Sapiens
RPMGLSRPE

SEQ ID NO: 1390495 - protein, 9 aa, Homo Sapiens
IPNLKSVDF

SEQ ID NO: 1390496 - protein, 9 aa, Homo Sapiens
EEAAASRLP

SEQ ID NO: 1390497 - protein, 9 aa, Homo Sapiens
QKKYPEAVC

SEQ ID NO: 1390498 - protein, 9 aa, Homo Sapiens
SSGCTSSSM

SEQ ID NO: 1390499 - protein, 9 aa, Homo Sapiens
FVAQLVVRL

SEQ ID NO: 1390500 - protein, 9 aa, Homo Sapiens
DDVENSAQG

SEQ ID NO: 1390501 - protein, 9 aa, Homo Sapiens
GAWHPGSWP

SEQ ID NO: 1390502 - protein, 9 aa, Homo Sapiens
QGAGVQDGA

SEQ ID NO: 1390503 - protein, 9 aa, Homo Sapiens
VGAAISMMY

SEQ ID NO: 1390504 - protein, 9 aa, Homo Sapiens
VSGGQFRAG

SEQ ID NO: 1390505 - protein, 9 aa, Homo Sapiens
DCTPMYTDV

SEQ ID NO: 1390506 - protein, 9 aa, Homo Sapiens
GTFILSCVA

SEQ ID NO: 1390507 - protein, 9 aa, Homo Sapiens
DDVFEDNTS

SEQ ID NO: 1390508 - protein, 9 aa, Homo Sapiens
WPTHLPSAP

SEQ ID NO: 1390509 - protein, 9 aa, Homo Sapiens
SWAIVCGVW

SEQ ID NO: 1390510 - protein, 9 aa, Homo Sapiens
GKSPQPPEL

SEQ ID NO: 1390511 - protein, 9 aa, Homo Sapiens
IHGAGKLPH

SEQ ID NO: 1390512 - protein, 9 aa, Homo Sapiens
SSSAWAPQT

SEQ ID NO: 1390513 - protein, 9 aa, Homo Sapiens
ADFKMEEKM

SEQ ID NO: 1390514 - protein, 9 aa, Homo Sapiens
CIADSQLAE

SEQ ID NO: 1390515 - protein, 9 aa, Homo Sapiens
LEPVLEGWM

SEQ ID NO: 1390516 - protein, 9 aa, Homo Sapiens
GKPTLSKKN

SEQ ID NO: 1390517 - protein, 9 aa, Homo Sapiens
KNLGIPKPL

SEQ ID NO: 1390518 - protein, 9 aa, Homo Sapiens
KEDMKELVV

SEQ ID NO: 1390519 - protein, 9 aa, Homo Sapiens
ASTYITLKR

SEQ ID NO: 1390520 - protein, 9 aa, Homo Sapiens
CLTEYMEHT

SEQ ID NO: 1390521 - protein, 9 aa, Homo Sapiens
STHDNLPEL

SEQ ID NO: 1390522 - protein, 9 aa, Homo Sapiens
LMRVLDAND

SEQ ID NO: 1390523 - protein, 9 aa, Homo Sapiens
SQKSVPCVP

SEQ ID NO: 1390524 - protein, 9 aa, Homo Sapiens
CTCQVRATG

SEQ ID NO: 1390525 - protein, 9 aa, Homo Sapiens
YRVSNMDGW

SEQ ID NO: 1390526 - protein, 9 aa, Homo Sapiens
NSGFGKILS

SEQ ID NO: 1390527 - protein, 9 aa, Homo Sapiens
PTEPPLPTA

SEQ ID NO: 1390528 - protein, 9 aa, Homo Sapiens
EKGDRSKRG

SEQ ID NO: 1390529 - protein, 9 aa, Homo Sapiens
AMKHYLLYQ

SEQ ID NO: 1390530 - protein, 9 aa, Homo Sapiens
TIYDAWFPD

SEQ ID NO: 1390531 - protein, 9 aa, Homo Sapiens
VWCNGKKIG

SEQ ID NO: 1390532 - protein, 9 aa, Homo Sapiens
QAKRGSSPS

SEQ ID NO: 1390533 - protein, 9 aa, Homo Sapiens
VASLWGGPC

SEQ ID NO: 1390534 - protein, 9 aa, Homo Sapiens
QLIEDIVCD

SEQ ID NO: 1390535 - protein, 9 aa, Homo Sapiens
VAIRVLLGF

SEQ ID NO: 1390536 - protein, 9 aa, Homo Sapiens
IQTFPLHQG

SEQ ID NO: 1390537 - protein, 9 aa, Homo Sapiens
LLCLEEPPR

SEQ ID NO: 1390538 - protein, 9 aa, Homo Sapiens
PSCVNCVQG

SEQ ID NO: 1390539 - protein, 9 aa, Homo Sapiens
LTLMDDIGS

SEQ ID NO: 1390540 - protein, 9 aa, Homo Sapiens
EEEEENQMA

SEQ ID NO: 1390541 - protein, 9 aa, Homo Sapiens
AREQQQQQP

SEQ ID NO: 1390542 - protein, 9 aa, Homo Sapiens
QIIEQSRRK

SEQ ID NO: 1390543 - protein, 9 aa, Homo Sapiens
EDASLMGLC

SEQ ID NO: 1390544 - protein, 9 aa, Homo Sapiens
RVLDCANNV

SEQ ID NO: 1390545 - protein, 9 aa, Homo Sapiens
KKATKLETC

SEQ ID NO: 1390546 - protein, 9 aa, Homo Sapiens
TRGKNFRKE

SEQ ID NO: 1390547 - protein, 9 aa, Homo Sapiens
CDWKPQWLR

SEQ ID NO: 1390548 - protein, 9 aa, Homo Sapiens
FSPFRIQHM

SEQ ID NO: 1390549 - protein, 9 aa, Homo Sapiens
PFEVVLQNL

SEQ ID NO: 1390550 - protein, 9 aa, Homo Sapiens
LIAYNGIPS

SEQ ID NO: 1390551 - protein, 9 aa, Homo Sapiens
LDERQIKIW

SEQ ID NO: 1390552 - protein, 9 aa, Homo Sapiens
RLCQTQANG

SEQ ID NO: 1390553 - protein, 9 aa, Homo Sapiens
EPGDPDAVV

SEQ ID NO: 1390554 - protein, 9 aa, Homo Sapiens
GDEVEEEET

SEQ ID NO: 1390555 - protein, 9 aa, Homo Sapiens
FDGRHVLDG

SEQ ID NO: 1390556 - protein, 9 aa, Homo Sapiens
SKDSLTCFN

SEQ ID NO: 1390557 - protein, 9 aa, Homo Sapiens
LEDWIEDML

SEQ ID NO: 1390558 - protein, 9 aa, Homo Sapiens
EASPTTHLQ

SEQ ID NO: 1390559 - protein, 9 aa, Homo Sapiens
TTGWLERAY

SEQ ID NO: 1390560 - protein, 9 aa, Homo Sapiens
SSQNWGSLP

SEQ ID NO: 1390561 - protein, 9 aa, Homo Sapiens
DSGNVQKAV

SEQ ID NO: 1390562 - protein, 9 aa, Homo Sapiens
AMDATLRKK

SEQ ID NO: 1390563 - protein, 9 aa, Homo Sapiens
KWKLTSSTS

SEQ ID NO: 1390564 - protein, 9 aa, Homo Sapiens
WACGRGALR

SEQ ID NO: 1390565 - protein, 9 aa, Homo Sapiens
RVPVAHCFA

SEQ ID NO: 1390566 - protein, 9 aa, Homo Sapiens
PVLEGWMPD

SEQ ID NO: 1390567 - protein, 9 aa, Homo Sapiens
ALVRFLRNP

SEQ ID NO: 1390568 - protein, 9 aa, Homo Sapiens
ALRPRPGQP

SEQ ID NO: 1390569 - protein, 9 aa, Homo Sapiens
AAEVSPSAR

SEQ ID NO: 1390570 - protein, 9 aa, Homo Sapiens
TNIMCSWLF

SEQ ID NO: 1390571 - protein, 9 aa, Homo Sapiens
VAEPAVAAP

SEQ ID NO: 1390572 - protein, 9 aa, Homo Sapiens
ATKPGLQER

SEQ ID NO: 1390573 - protein, 9 aa, Homo Sapiens
KKKPLHQAI

SEQ ID NO: 1390574 - protein, 9 aa, Homo Sapiens
LTHRLLCLE

SEQ ID NO: 1390575 - protein, 9 aa, Homo Sapiens
HPLGDTPQP

SEQ ID NO: 1390576 - protein, 9 aa, Homo Sapiens
LWLGAHAWL

SEQ ID NO: 1390577 - protein, 9 aa, Homo Sapiens
VKIVMCWRP

SEQ ID NO: 1390578 - protein, 9 aa, Homo Sapiens
FVFGQASLI

SEQ ID NO: 1390579 - protein, 9 aa, Homo Sapiens
EQKQAPSTR

SEQ ID NO: 1390580 - protein, 9 aa, Homo Sapiens
LRAAAEAAL

SEQ ID NO: 1390581 - protein, 9 aa, Homo Sapiens
HCKVLMRVL

SEQ ID NO: 1390582 - protein, 9 aa, Homo Sapiens
ASGARHGRF

SEQ ID NO: 1390583 - protein, 9 aa, Homo Sapiens
QSNQSLLSI

SEQ ID NO: 1390584 - protein, 9 aa, Homo Sapiens
RGTFGGNIT

SEQ ID NO: 1390585 - protein, 9 aa, Homo Sapiens
GATHHVAAD

SEQ ID NO: 1390586 - protein, 9 aa, Homo Sapiens
ETQWKVTVT

SEQ ID NO: 1390587 - protein, 9 aa, Homo Sapiens
LLTQPPTLG

SEQ ID NO: 1390588 - protein, 9 aa, Homo Sapiens
LWWPHGAYC

SEQ ID NO: 1390589 - protein, 9 aa, Homo Sapiens
AVGIPQQCI

SEQ ID NO: 1390590 - protein, 9 aa, Homo Sapiens
ELKSEEYLL

SEQ ID NO: 1390591 - protein, 9 aa, Homo Sapiens
AGDYDVEKN

SEQ ID NO: 1390592 - protein, 9 aa, Homo Sapiens
VGKGNVTRR

SEQ ID NO: 1390593 - protein, 9 aa, Homo Sapiens
PGSWPVAQR

SEQ ID NO: 1390594 - protein, 9 aa, Homo Sapiens
DGGSPPLDS

SEQ ID NO: 1390595 - protein, 9 aa, Homo Sapiens
LGGVLPCTL

SEQ ID NO: 1390596 - protein, 9 aa, Homo Sapiens
KDRQSFGPV

SEQ ID NO: 1390597 - protein, 9 aa, Homo Sapiens
LPCEAPFCC

SEQ ID NO: 1390598 - protein, 9 aa, Homo Sapiens
SPEEEPILW

SEQ ID NO: 1390599 - protein, 9 aa, Homo Sapiens
WAIVCGVWY

SEQ ID NO: 1390600 - protein, 9 aa, Homo Sapiens
PGQPPSPAR

SEQ ID NO: 1390601 - protein, 9 aa, Homo Sapiens
GAGVQDGAA

SEQ ID NO: 1390602 - protein, 9 aa, Homo Sapiens
FGPDAVAVP

SEQ ID NO: 1390603 - protein, 9 aa, Homo Sapiens
EDVMFISDD

SEQ ID NO: 1390604 - protein, 9 aa, Homo Sapiens
QKKLNLSTI

SEQ ID NO: 1390605 - protein, 9 aa, Homo Sapiens
ATLLVTAKK

SEQ ID NO: 1390606 - protein, 9 aa, Homo Sapiens
WSWQVSLRL

SEQ ID NO: 1390607 - protein, 9 aa, Homo Sapiens
ASPGRRDPQ

SEQ ID NO: 1390608 - protein, 9 aa, Homo Sapiens
LRRRSRSHG

SEQ ID NO: 1390609 - protein, 9 aa, Homo Sapiens
RPCRRSSSA

SEQ ID NO: 1390610 - protein, 9 aa, Homo Sapiens
KQSQQSLSL

SEQ ID NO: 1390611 - protein, 9 aa, Homo Sapiens
VEGSKRSSR

SEQ ID NO: 1390612 - protein, 9 aa, Homo Sapiens
YSLPRAFKV

SEQ ID NO: 1390613 - protein, 9 aa, Homo Sapiens
SGSLGRCGC

SEQ ID NO: 1390614 - protein, 9 aa, Homo Sapiens
PTTSSLVAS

SEQ ID NO: 1390615 - protein, 9 aa, Homo Sapiens
LMGKYVNFI

SEQ ID NO: 1390616 - protein, 9 aa, Homo Sapiens
MVLVLVFMK

SEQ ID NO: 1390617 - protein, 9 aa, Homo Sapiens
NFIGDRNIC

SEQ ID NO: 1390618 - protein, 9 aa, Homo Sapiens
TIATAILTG

SEQ ID NO: 1390619 - protein, 9 aa, Homo Sapiens
EKNSREDKR

SEQ ID NO: 1390620 - protein, 9 aa, Homo Sapiens
PSLRTISSS

SEQ ID NO: 1390621 - protein, 9 aa, Homo Sapiens
TTFCATLLA

SEQ ID NO: 1390622 - protein, 9 aa, Homo Sapiens
KYKEVVAQY

SEQ ID NO: 1390623 - protein, 9 aa, Homo Sapiens
EAREEPLES

SEQ ID NO: 1390624 - protein, 9 aa, Homo Sapiens
PVIPKDEKL

SEQ ID NO: 1390625 - protein, 9 aa, Homo Sapiens
ESHVPYWNS

SEQ ID NO: 1390626 - protein, 9 aa, Homo Sapiens
LEWRLGFLE

SEQ ID NO: 1390627 - protein, 9 aa, Homo Sapiens
SLPRAFKVP

SEQ ID NO: 1390628 - protein, 9 aa, Homo Sapiens
LGILIFRDW

SEQ ID NO: 1390629 - protein, 9 aa, Homo Sapiens
CVDMNATTV

SEQ ID NO: 1390630 - protein, 9 aa, Homo Sapiens
IHDLVKNVL

SEQ ID NO: 1390631 - protein, 9 aa, Homo Sapiens
EQQDSGSKP

SEQ ID NO: 1390632 - protein, 9 aa, Homo Sapiens
KHFRVLQHL

SEQ ID NO: 1390633 - protein, 9 aa, Homo Sapiens
FICFIEECS

SEQ ID NO: 1390634 - protein, 9 aa, Homo Sapiens
EDMEIMSHY

SEQ ID NO: 1390635 - protein, 9 aa, Homo Sapiens
LPSSSDTFF

SEQ ID NO: 1390636 - protein, 9 aa, Homo Sapiens
ILENTDSGD

SEQ ID NO: 1390637 - protein, 9 aa, Homo Sapiens
NLQRNLKVL

SEQ ID NO: 1390638 - protein, 9 aa, Homo Sapiens
RCCQQKEKG

SEQ ID NO: 1390639 - protein, 9 aa, Homo Sapiens
FLLLWMSES

SEQ ID NO: 1390640 - protein, 9 aa, Homo Sapiens
CLKKGRYLR

SEQ ID NO: 1390641 - protein, 9 aa, Homo Sapiens
LMMLQNAQV

SEQ ID NO: 1390642 - protein, 9 aa, Homo Sapiens
PKHATNIMC

SEQ ID NO: 1390643 - protein, 9 aa, Homo Sapiens
EDVRVQEVP

SEQ ID NO: 1390644 - protein, 9 aa, Homo Sapiens
MVADEYLNK

SEQ ID NO: 1390645 - protein, 9 aa, Homo Sapiens
KHVNLCACG

SEQ ID NO: 1390646 - protein, 9 aa, Homo Sapiens
APAVLDSIS

SEQ ID NO: 1390647 - protein, 9 aa, Homo Sapiens
KCAEGEMRG

SEQ ID NO: 1390648 - protein, 9 aa, Homo Sapiens
NLVACPDLR

SEQ ID NO: 1390649 - protein, 9 aa, Homo Sapiens
QDIPASHSD

SEQ ID NO: 1390650 - protein, 9 aa, Homo Sapiens
QARLSARMT

SEQ ID NO: 1390651 - protein, 9 aa, Homo Sapiens
NRLDIEVQI

SEQ ID NO: 1390652 - protein, 9 aa, Homo Sapiens
TGGSHCSTS

SEQ ID NO: 1390653 - protein, 9 aa, Homo Sapiens
ALPATLLVT

SEQ ID NO: 1390654 - protein, 9 aa, Homo Sapiens
YISCSSLKN

SEQ ID NO: 1390655 - protein, 9 aa, Homo Sapiens
RERTATEEK

SEQ ID NO: 1390656 - protein, 9 aa, Homo Sapiens
FQHLQLKEQ

SEQ ID NO: 1390657 - protein, 9 aa, Homo Sapiens
GEEEAAEAR

SEQ ID NO: 1390658 - protein, 9 aa, Homo Sapiens
RERGGGCLP

SEQ ID NO: 1390659 - protein, 9 aa, Homo Sapiens
PLTHRLLCL

SEQ ID NO: 1390660 - protein, 9 aa, Homo Sapiens
KKASAIAIK

SEQ ID NO: 1390661 - protein, 9 aa, Homo Sapiens
SGNVQKAVC

SEQ ID NO: 1390662 - protein, 9 aa, Homo Sapiens
RRLGAGAGG

SEQ ID NO: 1390663 - protein, 9 aa, Homo Sapiens
VKALSYKFS

SEQ ID NO: 1390664 - protein, 9 aa, Homo Sapiens
QYKLGVRLY

SEQ ID NO: 1390665 - protein, 9 aa, Homo Sapiens
IQAFMNSGF

SEQ ID NO: 1390666 - protein, 9 aa, Homo Sapiens
LRIQQRQDN

SEQ ID NO: 1390667 - protein, 9 aa, Homo Sapiens
NIAANIQDK

SEQ ID NO: 1390668 - protein, 9 aa, Homo Sapiens
RRRSRSHGG

SEQ ID NO: 1390669 - protein, 9 aa, Homo Sapiens
RFMFQKSST

SEQ ID NO: 1390670 - protein, 9 aa, Homo Sapiens
AVSYAGSAR

SEQ ID NO: 1390671 - protein, 9 aa, Homo Sapiens
VAAPSSDPP

SEQ ID NO: 1390672 - protein, 9 aa, Homo Sapiens
TGQNSTDMI

SEQ ID NO: 1390673 - protein, 9 aa, Homo Sapiens
LKRIFIPMT

SEQ ID NO: 1390674 - protein, 9 aa, Homo Sapiens
AMPQMQLQA

SEQ ID NO: 1390675 - protein, 9 aa, Homo Sapiens
CPLWRSTGG

SEQ ID NO: 1390676 - protein, 9 aa, Homo Sapiens
LGGLRANTV

SEQ ID NO: 1390677 - protein, 9 aa, Homo Sapiens
LKKTSFIIR

SEQ ID NO: 1390678 - protein, 9 aa, Homo Sapiens
TVQLHGMRK

SEQ ID NO: 1390679 - protein, 9 aa, Homo Sapiens
KPEEEEENQ

SEQ ID NO: 1390680 - protein, 9 aa, Homo Sapiens
PGPPWPTHL

SEQ ID NO: 1390681 - protein, 9 aa, Homo Sapiens
YFPLKIPPN

SEQ ID NO: 1390682 - protein, 9 aa, Homo Sapiens
ITDEAFYGL

SEQ ID NO: 1390683 - protein, 9 aa, Homo Sapiens
TIMSQRVCL

SEQ ID NO: 1390684 - protein, 9 aa, Homo Sapiens
ATEEKARRN

SEQ ID NO: 1390685 - protein, 9 aa, Homo Sapiens
SHTNSSVSS

SEQ ID NO: 1390686 - protein, 9 aa, Homo Sapiens
SLTPATPQK

SEQ ID NO: 1390687 - protein, 9 aa, Homo Sapiens
RAFKVPLLV

SEQ ID NO: 1390688 - protein, 9 aa, Homo Sapiens
CYRRSQQLH

SEQ ID NO: 1390689 - protein, 9 aa, Homo Sapiens
VLGAGVHGT

SEQ ID NO: 1390690 - protein, 9 aa, Homo Sapiens
AFKVPLLVP

SEQ ID NO: 1390691 - protein, 9 aa, Homo Sapiens
TLLPKDRYV

SEQ ID NO: 1390692 - protein, 9 aa, Homo Sapiens
KPRGDEDDI

SEQ ID NO: 1390693 - protein, 9 aa, Homo Sapiens
QGDTIECLK

SEQ ID NO: 1390694 - protein, 9 aa, Homo Sapiens
LFSNIESTS

SEQ ID NO: 1390695 - protein, 9 aa, Homo Sapiens
HIYRCEDEH

SEQ ID NO: 1390696 - protein, 9 aa, Homo Sapiens
SVGAGTWTT

SEQ ID NO: 1390697 - protein, 9 aa, Homo Sapiens
SSCCGRAPS

SEQ ID NO: 1390698 - protein, 9 aa, Homo Sapiens
PWLPMRSLG

SEQ ID NO: 1390699 - protein, 9 aa, Homo Sapiens
RKAMTKKRV

SEQ ID NO: 1390700 - protein, 9 aa, Homo Sapiens
QNAIRQHSL

SEQ ID NO: 1390701 - protein, 9 aa, Homo Sapiens
LGGPKAHWK

SEQ ID NO: 1390702 - protein, 9 aa, Homo Sapiens
ECRNLFAFT

SEQ ID NO: 1390703 - protein, 9 aa, Homo Sapiens
AEITDIKPI

SEQ ID NO: 1390704 - protein, 9 aa, Homo Sapiens
DSSAPHPPN

SEQ ID NO: 1390705 - protein, 9 aa, Homo Sapiens
KAKPISDNS

SEQ ID NO: 1390706 - protein, 9 aa, Homo Sapiens
QCVVLEARA

SEQ ID NO: 1390707 - protein, 9 aa, Homo Sapiens
GANPLMKPA

SEQ ID NO: 1390708 - protein, 9 aa, Homo Sapiens
VACSCSHRR

SEQ ID NO: 1390709 - protein, 9 aa, Homo Sapiens
LLTIMGYDR

SEQ ID NO: 1390710 - protein, 9 aa, Homo Sapiens
LDASAKKNS

SEQ ID NO: 1390711 - protein, 9 aa, Homo Sapiens
AVVKGMNSH

SEQ ID NO: 1390712 - protein, 9 aa, Homo Sapiens
DPQLAWVSF

SEQ ID NO: 1390713 - protein, 9 aa, Homo Sapiens
GGPEAPSTR

SEQ ID NO: 1390714 - protein, 9 aa, Homo Sapiens
VRCPACCMQ

SEQ ID NO: 1390715 - protein, 9 aa, Homo Sapiens
RKIQENYGD

SEQ ID NO: 1390716 - protein, 9 aa, Homo Sapiens
VKNVLENLQ

SEQ ID NO: 1390717 - protein, 9 aa, Homo Sapiens
RQGWGWGAW

SEQ ID NO: 1390718 - protein, 9 aa, Homo Sapiens
KTAIPTVLS

SEQ ID NO: 1390719 - protein, 9 aa, Homo Sapiens
LFKELGKGA

SEQ ID NO: 1390720 - protein, 9 aa, Homo Sapiens
FSQLYIRNL

SEQ ID NO: 1390721 - protein, 9 aa, Homo Sapiens
EAFRASLST

SEQ ID NO: 1390722 - protein, 9 aa, Homo Sapiens
THARTTASA

SEQ ID NO: 1390723 - protein, 9 aa, Homo Sapiens
KTKKTSFSL

SEQ ID NO: 1390724 - protein, 9 aa, Homo Sapiens
RTSPAPWTQ

SEQ ID NO: 1390725 - protein, 9 aa, Homo Sapiens
GTYICVASL

SEQ ID NO: 1390726 - protein, 9 aa, Homo Sapiens
GLLILLGIC

SEQ ID NO: 1390727 - protein, 9 aa, Homo Sapiens
ISGVNAKKM

SEQ ID NO: 1390728 - protein, 9 aa, Homo Sapiens
SASSPSWAW

SEQ ID NO: 1390729 - protein, 9 aa, Homo Sapiens
LCCYCPAHE

SEQ ID NO: 1390730 - protein, 9 aa, Homo Sapiens
MSGTSGKGF

SEQ ID NO: 1390731 - protein, 9 aa, Homo Sapiens
VARSEGKGR

SEQ ID NO: 1390732 - protein, 9 aa, Homo Sapiens
LKNIPGIRG

SEQ ID NO: 1390733 - protein, 9 aa, Homo Sapiens
VTKFLSSST

SEQ ID NO: 1390734 - protein, 9 aa, Homo Sapiens
VCVVYTGDV

SEQ ID NO: 1390735 - protein, 9 aa, Homo Sapiens
AVSAPQTET

SEQ ID NO: 1390736 - protein, 9 aa, Homo Sapiens
RCCRPRTRT

SEQ ID NO: 1390737 - protein, 9 aa, Homo Sapiens
CLCADYFKN

SEQ ID NO: 1390738 - protein, 9 aa, Homo Sapiens
SRKMRNPTF

SEQ ID NO: 1390739 - protein, 9 aa, Homo Sapiens
RDLVLKGKR

SEQ ID NO: 1390740 - protein, 9 aa, Homo Sapiens
FKLLWDRIV

SEQ ID NO: 1390741 - protein, 9 aa, Homo Sapiens
LHSDVEYAK

SEQ ID NO: 1390742 - protein, 9 aa, Homo Sapiens
HYPMFTEKE

SEQ ID NO: 1390743 - protein, 9 aa, Homo Sapiens
TVLLTRTTA

SEQ ID NO: 1390744 - protein, 9 aa, Homo Sapiens
DVRDSEKMS

SEQ ID NO: 1390745 - protein, 9 aa, Homo Sapiens
TPLHHPERI

SEQ ID NO: 1390746 - protein, 9 aa, Homo Sapiens
QRCIADSQL

SEQ ID NO: 1390747 - protein, 9 aa, Homo Sapiens
LGDTPQPSL

SEQ ID NO: 1390748 - protein, 9 aa, Homo Sapiens
FSNIESTSM

SEQ ID NO: 1390749 - protein, 9 aa, Homo Sapiens
LVSWKQSQQ

SEQ ID NO: 1390750 - protein, 9 aa, Homo Sapiens
EVNLSFFGL

SEQ ID NO: 1390751 - protein, 9 aa, Homo Sapiens
LPLDMYECL

SEQ ID NO: 1390752 - protein, 9 aa, Homo Sapiens
LLAPPQCPQ

SEQ ID NO: 1390753 - protein, 9 aa, Homo Sapiens
IESLDGITN

SEQ ID NO: 1390754 - protein, 9 aa, Homo Sapiens
FEDSGTETS

SEQ ID NO: 1390755 - protein, 9 aa, Homo Sapiens
LGSSCCGRA

SEQ ID NO: 1390756 - protein, 9 aa, Homo Sapiens
ESLDGITNL

SEQ ID NO: 1390757 - protein, 9 aa, Homo Sapiens
AFSPSYLPK

SEQ ID NO: 1390758 - protein, 9 aa, Homo Sapiens
AVSSLKKQY

SEQ ID NO: 1390759 - protein, 9 aa, Homo Sapiens
VEEWYNDSV

SEQ ID NO: 1390760 - protein, 9 aa, Homo Sapiens
ERAYGRLWR

SEQ ID NO: 1390761 - protein, 9 aa, Homo Sapiens
RQLNTTLPQ

SEQ ID NO: 1390762 - protein, 9 aa, Homo Sapiens
ARAHQRTGR

SEQ ID NO: 1390763 - protein, 9 aa, Homo Sapiens
CSITVSFVG

SEQ ID NO: 1390764 - protein, 9 aa, Homo Sapiens
QIFICFIEE

SEQ ID NO: 1390765 - protein, 9 aa, Homo Sapiens
GVILKHFRV

SEQ ID NO: 1390766 - protein, 9 aa, Homo Sapiens
QKRAPINSA

SEQ ID NO: 1390767 - protein, 9 aa, Homo Sapiens
LVALPPVTS

SEQ ID NO: 1390768 - protein, 9 aa, Homo Sapiens
KGDESKISY

SEQ ID NO: 1390769 - protein, 9 aa, Homo Sapiens
CCSWSCWSA

SEQ ID NO: 1390770 - protein, 9 aa, Homo Sapiens
VWTAATLRC

SEQ ID NO: 1390771 - protein, 9 aa, Homo Sapiens
GKLPHHMRT

SEQ ID NO: 1390772 - protein, 9 aa, Homo Sapiens
TSIFLIPSL

SEQ ID NO: 1390773 - protein, 9 aa, Homo Sapiens
KIVMCWRPP

SEQ ID NO: 1390774 - protein, 9 aa, Homo Sapiens
AAVGKARRR

SEQ ID NO: 1390775 - protein, 9 aa, Homo Sapiens
MLEALSEGL

SEQ ID NO: 1390776 - protein, 9 aa, Homo Sapiens
IPECFNETI

SEQ ID NO: 1390777 - protein, 9 aa, Homo Sapiens
DQKTAIPTV

SEQ ID NO: 1390778 - protein, 9 aa, Homo Sapiens
VLPQAQLQG

SEQ ID NO: 1390779 - protein, 9 aa, Homo Sapiens
LRLQSLLSL

SEQ ID NO: 1390780 - protein, 9 aa, Homo Sapiens
TTTPPHCSP

SEQ ID NO: 1390781 - protein, 9 aa, Homo Sapiens
FLTTSEEAQ

SEQ ID NO: 1390782 - protein, 9 aa, Homo Sapiens
RRAPAVLDS

SEQ ID NO: 1390783 - protein, 9 aa, Homo Sapiens
WMIVIIKDI

SEQ ID NO: 1390784 - protein, 9 aa, Homo Sapiens
FTEEYQLFK

SEQ ID NO: 1390785 - protein, 9 aa, Homo Sapiens
DRLGEGTYA

SEQ ID NO: 1390786 - protein, 9 aa, Homo Sapiens
QRQLNTTLP

SEQ ID NO: 1390787 - protein, 9 aa, Homo Sapiens
QQQGPPPQG

SEQ ID NO: 1390788 - protein, 9 aa, Homo Sapiens
EKCVLETEL

SEQ ID NO: 1390789 - protein, 9 aa, Homo Sapiens
RETKEEYLV

SEQ ID NO: 1390790 - protein, 9 aa, Homo Sapiens
EGPGLGAAQ

SEQ ID NO: 1390791 - protein, 9 aa, Homo Sapiens
SSAISKVKL

SEQ ID NO: 1390792 - protein, 9 aa, Homo Sapiens
KLGVPELLV

SEQ ID NO: 1390793 - protein, 9 aa, Homo Sapiens
KRWEPFRKV

SEQ ID NO: 1390794 - protein, 9 aa, Homo Sapiens
GRHMCSMKK

SEQ ID NO: 1390795 - protein, 9 aa, Homo Sapiens
SKSFISSQS

SEQ ID NO: 1390796 - protein, 9 aa, Homo Sapiens
GRVAEPAVA

SEQ ID NO: 1390797 - protein, 9 aa, Homo Sapiens
PPSLRAARA

SEQ ID NO: 1390798 - protein, 9 aa, Homo Sapiens
MQRFTSPKV

SEQ ID NO: 1390799 - protein, 9 aa, Homo Sapiens
GAAISMMYI

SEQ ID NO: 1390800 - protein, 9 aa, Homo Sapiens
SGRWTTRPC

SEQ ID NO: 1390801 - protein, 9 aa, Homo Sapiens
GAGGRSGRA

SEQ ID NO: 1390802 - protein, 9 aa, Homo Sapiens
AWAPQTAVL

SEQ ID NO: 1390803 - protein, 9 aa, Homo Sapiens
AFRRFSSPR

SEQ ID NO: 1390804 - protein, 9 aa, Homo Sapiens
QISTLVLDV

SEQ ID NO: 1390805 - protein, 9 aa, Homo Sapiens
RHLLGDAHV

SEQ ID NO: 1390806 - protein, 9 aa, Homo Sapiens
FVPEKWRKC

SEQ ID NO: 1390807 - protein, 9 aa, Homo Sapiens
YQTEGTWDQ

SEQ ID NO: 1390808 - protein, 9 aa, Homo Sapiens
SSRFGLFHI

SEQ ID NO: 1390809 - protein, 9 aa, Homo Sapiens
CKNGQVWAS

SEQ ID NO: 1390810 - protein, 9 aa, Homo Sapiens
GAMKVQSQA

SEQ ID NO: 1390811 - protein, 9 aa, Homo Sapiens
HITVLAVVQ

SEQ ID NO: 1390812 - protein, 9 aa, Homo Sapiens
SSLYVSPSE

SEQ ID NO: 1390813 - protein, 9 aa, Homo Sapiens
NAIRQHSLG

SEQ ID NO: 1390814 - protein, 9 aa, Homo Sapiens
HALSWSYDI

SEQ ID NO: 1390815 - protein, 9 aa, Homo Sapiens
GLKMKCVGH

SEQ ID NO: 1390816 - protein, 9 aa, Homo Sapiens
PTLQAIACD

SEQ ID NO: 1390817 - protein, 9 aa, Homo Sapiens
CIGVTNHCD

SEQ ID NO: 1390818 - protein, 9 aa, Homo Sapiens
DSPPRGRSQ

SEQ ID NO: 1390819 - protein, 9 aa, Homo Sapiens
KILMTGKDL

SEQ ID NO: 1390820 - protein, 9 aa, Homo Sapiens
FMFQKSSTS

SEQ ID NO: 1390821 - protein, 9 aa, Homo Sapiens
NTVDTATKP

SEQ ID NO: 1390822 - protein, 9 aa, Homo Sapiens
KFKQAKRGS

SEQ ID NO: 1390823 - protein, 9 aa, Homo Sapiens
EFEGCDWRF

SEQ ID NO: 1390824 - protein, 9 aa, Homo Sapiens
CGVWYMPPM

SEQ ID NO: 1390825 - protein, 9 aa, Homo Sapiens
AELCQVQSQ

SEQ ID NO: 1390826 - protein, 9 aa, Homo Sapiens
QMRRRSQRR

SEQ ID NO: 1390827 - protein, 9 aa, Homo Sapiens
CTTSHLEGT

SEQ ID NO: 1390828 - protein, 9 aa, Homo Sapiens
LLMLPPIFG

SEQ ID NO: 1390829 - protein, 9 aa, Homo Sapiens
GFAVGIPQQ

SEQ ID NO: 1390830 - protein, 9 aa, Homo Sapiens
VELMDHKTQ

SEQ ID NO: 1390831 - protein, 9 aa, Homo Sapiens
ITVSDVNDN

SEQ ID NO: 1390832 - protein, 9 aa, Homo Sapiens
VSFVGQIST

SEQ ID NO: 1390833 - protein, 9 aa, Homo Sapiens
GDESKISYP

SEQ ID NO: 1390834 - protein, 9 aa, Homo Sapiens
MDPGPGAWT

SEQ ID NO: 1390835 - protein, 9 aa, Homo Sapiens
DMMVDFRVS

SEQ ID NO: 1390836 - protein, 9 aa, Homo Sapiens
TDIFKRFNS

SEQ ID NO: 1390837 - protein, 9 aa, Homo Sapiens
REDHSRLQK

SEQ ID NO: 1390838 - protein, 9 aa, Homo Sapiens
QQQQQSQQQ

SEQ ID NO: 1390839 - protein, 9 aa, Homo Sapiens
DPVTFKSRN

SEQ ID NO: 1390840 - protein, 9 aa, Homo Sapiens
ESHKLFSFQ

SEQ ID NO: 1390841 - protein, 9 aa, Homo Sapiens
LYVRDTLQL

SEQ ID NO: 1390842 - protein, 9 aa, Homo Sapiens
HQLIMNTST

SEQ ID NO: 1390843 - protein, 9 aa, Homo Sapiens
VHNLTEGSL

SEQ ID NO: 1390844 - protein, 9 aa, Homo Sapiens
GVPLSPCRW

SEQ ID NO: 1390845 - protein, 9 aa, Homo Sapiens
LPMIVGSYL

SEQ ID NO: 1390846 - protein, 9 aa, Homo Sapiens
GSLDGGANS

SEQ ID NO: 1390847 - protein, 9 aa, Homo Sapiens
QKLTFRVAI

SEQ ID NO: 1390848 - protein, 9 aa, Homo Sapiens
PPLGGGGIG

SEQ ID NO: 1390849 - protein, 9 aa, Homo Sapiens
IVKNWVSCC

SEQ ID NO: 1390850 - protein, 9 aa, Homo Sapiens
RAPAPTCVS

SEQ ID NO: 1390851 - protein, 9 aa, Homo Sapiens
LCNFSCFFS

SEQ ID NO: 1390852 - protein, 9 aa, Homo Sapiens
LGWCLTGTH

SEQ ID NO: 1390853 - protein, 9 aa, Homo Sapiens
GEQTHWLRP

SEQ ID NO: 1390854 - protein, 9 aa, Homo Sapiens
LLSTLSQPP

SEQ ID NO: 1390855 - protein, 9 aa, Homo Sapiens
PMYTDVISE

SEQ ID NO: 1390856 - protein, 9 aa, Homo Sapiens
SATVQAFLK

SEQ ID NO: 1390857 - protein, 9 aa, Homo Sapiens
HASCLCPLA

SEQ ID NO: 1390858 - protein, 9 aa, Homo Sapiens
EPALVRFLR

SEQ ID NO: 1390859 - protein, 9 aa, Homo Sapiens
DNKPPIQMP

SEQ ID NO: 1390860 - protein, 9 aa, Homo Sapiens
GDSWRSLLS

SEQ ID NO: 1390861 - protein, 9 aa, Homo Sapiens
LHCTWDPGM

SEQ ID NO: 1390862 - protein, 9 aa, Homo Sapiens
QMAGRPGHR

SEQ ID NO: 1390863 - protein, 9 aa, Homo Sapiens
RNLQRNLKV

SEQ ID NO: 1390864 - protein, 9 aa, Homo Sapiens
CSLKQVHLV

SEQ ID NO: 1390865 - protein, 9 aa, Homo Sapiens
VGMLGSWYT

SEQ ID NO: 1390866 - protein, 9 aa, Homo Sapiens
NKLTFSFSL

SEQ ID NO: 1390867 - protein, 9 aa, Homo Sapiens
LCPLASQAI

SEQ ID NO: 1390868 - protein, 9 aa, Homo Sapiens
SEDVQAALK

SEQ ID NO: 1390869 - protein, 9 aa, Homo Sapiens
TQLKITVSD

SEQ ID NO: 1390870 - protein, 9 aa, Homo Sapiens
EHSNTLIQQ

SEQ ID NO: 1390871 - protein, 9 aa, Homo Sapiens
STRAAPPSL

SEQ ID NO: 1390872 - protein, 9 aa, Homo Sapiens
SRKAFRRFS

SEQ ID NO: 1390873 - protein, 9 aa, Homo Sapiens
VLCCYCPAH

SEQ ID NO: 1390874 - protein, 9 aa, Homo Sapiens
PSNMLPVRS

SEQ ID NO: 1390875 - protein, 9 aa, Homo Sapiens
TSCCHAPGL

SEQ ID NO: 1390876 - protein, 9 aa, Homo Sapiens
FAACWSPWA

SEQ ID NO: 1390877 - protein, 9 aa, Homo Sapiens
NPDFVPEKW

SEQ ID NO: 1390878 - protein, 9 aa, Homo Sapiens
PLRTPLTLA

SEQ ID NO: 1390879 - protein, 9 aa, Homo Sapiens
YVFMNQQFR

SEQ ID NO: 1390880 - protein, 9 aa, Homo Sapiens
GNSAMSQPA

SEQ ID NO: 1390881 - protein, 9 aa, Homo Sapiens
INPAKCITA

SEQ ID NO: 1390882 - protein, 9 aa, Homo Sapiens
SSGGRTAAV

SEQ ID NO: 1390883 - protein, 9 aa, Homo Sapiens
LHLATAWPH

SEQ ID NO: 1390884 - protein, 9 aa, Homo Sapiens
VLMIISLPT

SEQ ID NO: 1390885 - protein, 9 aa, Homo Sapiens
QQCDTDDDM

SEQ ID NO: 1390886 - protein, 9 aa, Homo Sapiens
IIIPLERRS

SEQ ID NO: 1390887 - protein, 9 aa, Homo Sapiens
MTGKDLGPA

SEQ ID NO: 1390888 - protein, 9 aa, Homo Sapiens
DESKISYPN

SEQ ID NO: 1390889 - protein, 9 aa, Homo Sapiens
RVNAVEELH

SEQ ID NO: 1390890 - protein, 9 aa, Homo Sapiens
RAARAHQRT

SEQ ID NO: 1390891 - protein, 9 aa, Homo Sapiens
SGTHHVVPA

SEQ ID NO: 1390892 - protein, 9 aa, Homo Sapiens
TQDHQPTPD

SEQ ID NO: 1390893 - protein, 9 aa, Homo Sapiens
VAFRLASTT

SEQ ID NO: 1390894 - protein, 9 aa, Homo Sapiens
KLSAGQNAT

SEQ ID NO: 1390895 - protein, 9 aa, Homo Sapiens
TYICVASLK

SEQ ID NO: 1390896 - protein, 9 aa, Homo Sapiens
LACSITVSF

SEQ ID NO: 1390897 - protein, 9 aa, Homo Sapiens
TIFMAQKEM

SEQ ID NO: 1390898 - protein, 9 aa, Homo Sapiens
ASKTLDSVA

SEQ ID NO: 1390899 - protein, 9 aa, Homo Sapiens
KKKATKLET

SEQ ID NO: 1390900 - protein, 9 aa, Homo Sapiens
GSKPRGDED

SEQ ID NO: 1390901 - protein, 9 aa, Homo Sapiens
ALHHRLCPA

SEQ ID NO: 1390902 - protein, 9 aa, Homo Sapiens
IHCEEKGRC

SEQ ID NO: 1390903 - protein, 9 aa, Homo Sapiens
ISVKTRSEW

SEQ ID NO: 1390904 - protein, 9 aa, Homo Sapiens
RFPREHRIG

SEQ ID NO: 1390905 - protein, 9 aa, Homo Sapiens
ERIHQSPYG

SEQ ID NO: 1390906 - protein, 9 aa, Homo Sapiens
QHLFLNSNG

SEQ ID NO: 1390907 - protein, 9 aa, Homo Sapiens
GFLLEGAGS

SEQ ID NO: 1390908 - protein, 9 aa, Homo Sapiens
FSLDRGCNW

SEQ ID NO: 1390909 - protein, 9 aa, Homo Sapiens
ITDIKPILR

SEQ ID NO: 1390910 - protein, 9 aa, Homo Sapiens
VKNWVSCCY

SEQ ID NO: 1390911 - protein, 9 aa, Homo Sapiens
SEPRQAEIQ

SEQ ID NO: 1390912 - protein, 9 aa, Homo Sapiens
LILLGICTV

SEQ ID NO: 1390913 - protein, 9 aa, Homo Sapiens
NIMCSWLFQ

SEQ ID NO: 1390914 - protein, 9 aa, Homo Sapiens
GDVIDLKKE

SEQ ID NO: 1390915 - protein, 9 aa, Homo Sapiens
LILTTLSWT

SEQ ID NO: 1390916 - protein, 9 aa, Homo Sapiens
LSPCNASIM

SEQ ID NO: 1390917 - protein, 9 aa, Homo Sapiens
IVGSPIWHV

SEQ ID NO: 1390918 - protein, 9 aa, Homo Sapiens
EVLKKQLFE

SEQ ID NO: 1390919 - protein, 9 aa, Homo Sapiens
TSSLVASSQ

SEQ ID NO: 1390920 - protein, 9 aa, Homo Sapiens
GGSPPLDST

SEQ ID NO: 1390921 - protein, 9 aa, Homo Sapiens
KKRKKREKI

SEQ ID NO: 1390922 - protein, 9 aa, Homo Sapiens
TPDCTPMYT

SEQ ID NO: 1390923 - protein, 9 aa, Homo Sapiens
DASAKKNSG

SEQ ID NO: 1390924 - protein, 9 aa, Homo Sapiens
STCPGEQLR

SEQ ID NO: 1390925 - protein, 9 aa, Homo Sapiens
PGDPDAVVA

SEQ ID NO: 1390926 - protein, 9 aa, Homo Sapiens
KPTLSKKNP

SEQ ID NO: 1390927 - protein, 9 aa, Homo Sapiens
LPKIFRKMS

SEQ ID NO: 1390928 - protein, 9 aa, Homo Sapiens
PSRWAPRST

SEQ ID NO: 1390929 - protein, 9 aa, Homo Sapiens
RRNNMMNKM

SEQ ID NO: 1390930 - protein, 9 aa, Homo Sapiens
QNLKELRES

SEQ ID NO: 1390931 - protein, 9 aa, Homo Sapiens
SGTSGKGFV

SEQ ID NO: 1390932 - protein, 9 aa, Homo Sapiens
DLPWRGVGE

SEQ ID NO: 1390933 - protein, 9 aa, Homo Sapiens
MQYLAATSA

SEQ ID NO: 1390934 - protein, 9 aa, Homo Sapiens
AVGQVLKGT

SEQ ID NO: 1390935 - protein, 9 aa, Homo Sapiens
LRKAITDHV

SEQ ID NO: 1390936 - protein, 9 aa, Homo Sapiens
YEQKNSSRA

SEQ ID NO: 1390937 - protein, 9 aa, Homo Sapiens
PAPWTQRTS

SEQ ID NO: 1390938 - protein, 9 aa, Homo Sapiens
TVTPRESMT

SEQ ID NO: 1390939 - protein, 9 aa, Homo Sapiens
SWRWGTLRF

SEQ ID NO: 1390940 - protein, 9 aa, Homo Sapiens
GLVHEALQL

SEQ ID NO: 1390941 - protein, 9 aa, Homo Sapiens
RTCSWQVLQ

SEQ ID NO: 1390942 - protein, 9 aa, Homo Sapiens
LFRIVFQIF

SEQ ID NO: 1390943 - protein, 9 aa, Homo Sapiens
HFFVLTKAS

SEQ ID NO: 1390944 - protein, 9 aa, Homo Sapiens
PVEDPESKQ

SEQ ID NO: 1390945 - protein, 9 aa, Homo Sapiens
QDGAAEEEG

SEQ ID NO: 1390946 - protein, 9 aa, Homo Sapiens
SPEVGLVHE

SEQ ID NO: 1390947 - protein, 9 aa, Homo Sapiens
REASIHTSC

SEQ ID NO: 1390948 - protein, 9 aa, Homo Sapiens
AKVLDQSDN

SEQ ID NO: 1390949 - protein, 9 aa, Homo Sapiens
LLWELVTWE

SEQ ID NO: 1390950 - protein, 9 aa, Homo Sapiens
ETVEVPKDN

SEQ ID NO: 1390951 - protein, 9 aa, Homo Sapiens
AAEAALSQT

SEQ ID NO: 1390952 - protein, 9 aa, Homo Sapiens
RLQKVPKIP

SEQ ID NO: 1390953 - protein, 9 aa, Homo Sapiens
ASSTRPAAA

SEQ ID NO: 1390954 - protein, 9 aa, Homo Sapiens
LKSEEYLLC

SEQ ID NO: 1390955 - protein, 9 aa, Homo Sapiens
FISSQSFSH

SEQ ID NO: 1390956 - protein, 9 aa, Homo Sapiens
PSHHPAPES

SEQ ID NO: 1390957 - protein, 9 aa, Homo Sapiens
RLGFLEPGE

SEQ ID NO: 1390958 - protein, 9 aa, Homo Sapiens
RWLKMCPLW

SEQ ID NO: 1390959 - protein, 9 aa, Homo Sapiens
PIFGDLLRE

SEQ ID NO: 1390960 - protein, 9 aa, Homo Sapiens
GEELATPPL

SEQ ID NO: 1390961 - protein, 9 aa, Homo Sapiens
GCPVWYNII

SEQ ID NO: 1390962 - protein, 9 aa, Homo Sapiens
CKVHITVLA

SEQ ID NO: 1390963 - protein, 9 aa, Homo Sapiens
KSVDFEAVA

SEQ ID NO: 1390964 - protein, 9 aa, Homo Sapiens
MEPSRSSWL

SEQ ID NO: 1390965 - protein, 9 aa, Homo Sapiens
KVHIFKYPS

SEQ ID NO: 1390966 - protein, 9 aa, Homo Sapiens
PKILMTGKD

SEQ ID NO: 1390967 - protein, 9 aa, Homo Sapiens
PVTFKSRNS

SEQ ID NO: 1390968 - protein, 9 aa, Homo Sapiens
NRIDETKHS

SEQ ID NO: 1390969 - protein, 9 aa, Homo Sapiens
RPQNPSNRS

SEQ ID NO: 1390970 - protein, 9 aa, Homo Sapiens
RWGAWHPGS

SEQ ID NO: 1390971 - protein, 9 aa, Homo Sapiens
AAPPTHART

SEQ ID NO: 1390972 - protein, 9 aa, Homo Sapiens
GRGTTDRHF

SEQ ID NO: 1390973 - protein, 9 aa, Homo Sapiens
MGGNRSICL

SEQ ID NO: 1390974 - protein, 9 aa, Homo Sapiens
SHLVHHKRM

SEQ ID NO: 1390975 - protein, 9 aa, Homo Sapiens
FSPIPITVT

SEQ ID NO: 1390976 - protein, 9 aa, Homo Sapiens
IPRKGQKFG

SEQ ID NO: 1390977 - protein, 9 aa, Homo Sapiens
VLEARAPHV

SEQ ID NO: 1390978 - protein, 9 aa, Homo Sapiens
SKENRRPPS

SEQ ID NO: 1390979 - protein, 9 aa, Homo Sapiens
GATFETTFP

SEQ ID NO: 1390980 - protein, 9 aa, Homo Sapiens
LFVFNFFWV

SEQ ID NO: 1390981 - protein, 9 aa, Homo Sapiens
HLPLPSEFL

SEQ ID NO: 1390982 - protein, 9 aa, Homo Sapiens
APPLTNTSA

SEQ ID NO: 1390983 - protein, 9 aa, Homo Sapiens
PAFIFDGRH

SEQ ID NO: 1390984 - protein, 9 aa, Homo Sapiens
GLFHIDFED

SEQ ID NO: 1390985 - protein, 9 aa, Homo Sapiens
RSEWQLLRL

SEQ ID NO: 1390986 - protein, 9 aa, Homo Sapiens
DENRSFEGI

SEQ ID NO: 1390987 - protein, 9 aa, Homo Sapiens
TLWLFWMSP

SEQ ID NO: 1390988 - protein, 9 aa, Homo Sapiens
RTSLHQATR

SEQ ID NO: 1390989 - protein, 9 aa, Homo Sapiens
ALKNSFEGQ

SEQ ID NO: 1390990 - protein, 9 aa, Homo Sapiens
VAVIVGSPI

SEQ ID NO: 1390991 - protein, 9 aa, Homo Sapiens
APPTHARTT

SEQ ID NO: 1390992 - protein, 9 aa, Homo Sapiens
LQARLALPA

SEQ ID NO: 1390993 - protein, 9 aa, Homo Sapiens
RGKSQGGRI

SEQ ID NO: 1390994 - protein, 9 aa, Homo Sapiens
LWDWAPRQT

SEQ ID NO: 1390995 - protein, 9 aa, Homo Sapiens
PEWKCSPLS

SEQ ID NO: 1390996 - protein, 9 aa, Homo Sapiens
HKVLAWWFC

SEQ ID NO: 1390997 - protein, 9 aa, Homo Sapiens
QKYHSVCHL

SEQ ID NO: 1390998 - protein, 9 aa, Homo Sapiens
ALCAVELKS

SEQ ID NO: 1390999 - protein, 9 aa, Homo Sapiens
CLINYYESK

SEQ ID NO: 1391000 - protein, 9 aa, Homo Sapiens
LFSSCTLDQ

SEQ ID NO: 1391001 - protein, 9 aa, Homo Sapiens
YRCEDEHFE

SEQ ID NO: 1391002 - protein, 9 aa, Homo Sapiens
KHPMDSKGD

SEQ ID NO: 1391003 - protein, 9 aa, Homo Sapiens
SAVCVMLDL

SEQ ID NO: 1391004 - protein, 9 aa, Homo Sapiens
PLALAMGQT

SEQ ID NO: 1391005 - protein, 9 aa, Homo Sapiens
MSSELSKKR

SEQ ID NO: 1391006 - protein, 9 aa, Homo Sapiens
SAEIPTGSE

SEQ ID NO: 1391007 - protein, 9 aa, Homo Sapiens
WMTCPPWTL

SEQ ID NO: 1391008 - protein, 9 aa, Homo Sapiens
MNPQPTPWA

SEQ ID NO: 1391009 - protein, 9 aa, Homo Sapiens
SVHNLTEGS

SEQ ID NO: 1391010 - protein, 9 aa, Homo Sapiens
KARRVIVER

SEQ ID NO: 1391011 - protein, 9 aa, Homo Sapiens
KWLRKCAKI

SEQ ID NO: 1391012 - protein, 9 aa, Homo Sapiens
KIRGKLGVS

SEQ ID NO: 1391013 - protein, 9 aa, Homo Sapiens
ALSKENRRP

SEQ ID NO: 1391014 - protein, 9 aa, Homo Sapiens
SSAWAPQTA

SEQ ID NO: 1391015 - protein, 9 aa, Homo Sapiens
RFCFKLMVL

SEQ ID NO: 1391016 - protein, 9 aa, Homo Sapiens
TATEEKARR

SEQ ID NO: 1391017 - protein, 9 aa, Homo Sapiens
PTTQPDDNK

SEQ ID NO: 1391018 - protein, 9 aa, Homo Sapiens
RLHAELRAE

SEQ ID NO: 1391019 - protein, 9 aa, Homo Sapiens
TVAVDGTFI

SEQ ID NO: 1391020 - protein, 9 aa, Homo Sapiens
EVAQLRRQV

SEQ ID NO: 1391021 - protein, 9 aa, Homo Sapiens
NLCPAVKEP

SEQ ID NO: 1391022 - protein, 9 aa, Homo Sapiens
RFRRDHAAA

SEQ ID NO: 1391023 - protein, 9 aa, Homo Sapiens
LRANTVLER

SEQ ID NO: 1391024 - protein, 9 aa, Homo Sapiens
WLSWRWGTL

SEQ ID NO: 1391025 - protein, 9 aa, Homo Sapiens
GWGPEDGVN

SEQ ID NO: 1391026 - protein, 9 aa, Homo Sapiens
ESLKRSKEP

SEQ ID NO: 1391027 - protein, 9 aa, Homo Sapiens
WWTMGLRPW

SEQ ID NO: 1391028 - protein, 9 aa, Homo Sapiens
ILDSSHTQR

SEQ ID NO: 1391029 - protein, 9 aa, Homo Sapiens
LALEGVQTP

SEQ ID NO: 1391030 - protein, 9 aa, Homo Sapiens
LSKTQIFIC

SEQ ID NO: 1391031 - protein, 9 aa, Homo Sapiens
LIMDHPSMH

SEQ ID NO: 1391032 - protein, 9 aa, Homo Sapiens
TDCFVAQLV

SEQ ID NO: 1391033 - protein, 9 aa, Homo Sapiens
TLTIYDAWF

SEQ ID NO: 1391034 - protein, 9 aa, Homo Sapiens
MLHHFHTHP

SEQ ID NO: 1391035 - protein, 9 aa, Homo Sapiens
AWLWYHQVV

SEQ ID NO: 1391036 - protein, 9 aa, Homo Sapiens
HGGDMSNRH

SEQ ID NO: 1391037 - protein, 9 aa, Homo Sapiens
QPSLPGPCA

SEQ ID NO: 1391038 - protein, 9 aa, Homo Sapiens
STCASHFCQ

SEQ ID NO: 1391039 - protein, 9 aa, Homo Sapiens
TSLAGQAEV

SEQ ID NO: 1391040 - protein, 9 aa, Homo Sapiens
SHASTHDNL

SEQ ID NO: 1391041 - protein, 9 aa, Homo Sapiens
CSSWRRAPA

SEQ ID NO: 1391042 - protein, 9 aa, Homo Sapiens
GTTASVVIT

SEQ ID NO: 1391043 - protein, 9 aa, Homo Sapiens
DGEFSPIPI

SEQ ID NO: 1391044 - protein, 9 aa, Homo Sapiens
IMDHPSMHI

SEQ ID NO: 1391045 - protein, 9 aa, Homo Sapiens
LLLANIWVG

SEQ ID NO: 1391046 - protein, 9 aa, Homo Sapiens
GLFFLDKSF

SEQ ID NO: 1391047 - protein, 9 aa, Homo Sapiens
AVHHCSSRK

SEQ ID NO: 1391048 - protein, 9 aa, Homo Sapiens
VGAPCFLRS

SEQ ID NO: 1391049 - protein, 9 aa, Homo Sapiens
GCSTTAATS

SEQ ID NO: 1391050 - protein, 9 aa, Homo Sapiens
VQLDPGAGS

SEQ ID NO: 1391051 - protein, 9 aa, Homo Sapiens
GSRKCKHRK

SEQ ID NO: 1391052 - protein, 9 aa, Homo Sapiens
DLGNGDFQM

SEQ ID NO: 1391053 - protein, 9 aa, Homo Sapiens
YSLGRNPTL

SEQ ID NO: 1391054 - protein, 9 aa, Homo Sapiens
DVVCKVHIT

SEQ ID NO: 1391055 - protein, 9 aa, Homo Sapiens
NSAQKNECT

SEQ ID NO: 1391056 - protein, 9 aa, Homo Sapiens
PTGDQDRAP

SEQ ID NO: 1391057 - protein, 9 aa, Homo Sapiens
VQVGGISPP

SEQ ID NO: 1391058 - protein, 9 aa, Homo Sapiens
CFSSEGGTY

SEQ ID NO: 1391059 - protein, 9 aa, Homo Sapiens
YVIKCDMSV

SEQ ID NO: 1391060 - protein, 9 aa, Homo Sapiens
SNRSLPHAP

SEQ ID NO: 1391061 - protein, 9 aa, Homo Sapiens
PKIGVAIQE

SEQ ID NO: 1391062 - protein, 9 aa, Homo Sapiens
TLKRIFIPM

SEQ ID NO: 1391063 - protein, 9 aa, Homo Sapiens
SSLLSPCNA

SEQ ID NO: 1391064 - protein, 9 aa, Homo Sapiens
TVLMIISLP

SEQ ID NO: 1391065 - protein, 9 aa, Homo Sapiens
LNWSLFTGL

SEQ ID NO: 1391066 - protein, 9 aa, Homo Sapiens
LNRLDIEVQ

SEQ ID NO: 1391067 - protein, 9 aa, Homo Sapiens
KMYHCDMYV

SEQ ID NO: 1391068 - protein, 9 aa, Homo Sapiens
TAWTCHWTI

SEQ ID NO: 1391069 - protein, 9 aa, Homo Sapiens
LLMLGLLIE

SEQ ID NO: 1391070 - protein, 9 aa, Homo Sapiens
DDEIPRKGQ

SEQ ID NO: 1391071 - protein, 9 aa, Homo Sapiens
LTVSFLKEH

SEQ ID NO: 1391072 - protein, 9 aa, Homo Sapiens
LRGVILKHF

SEQ ID NO: 1391073 - protein, 9 aa, Homo Sapiens
SGLVVSLWG

SEQ ID NO: 1391074 - protein, 9 aa, Homo Sapiens
SVYPHFLLQ

SEQ ID NO: 1391075 - protein, 9 aa, Homo Sapiens
PWSPSTQTT

SEQ ID NO: 1391076 - protein, 9 aa, Homo Sapiens
TSYYKSLNL

SEQ ID NO: 1391077 - protein, 9 aa, Homo Sapiens
MALAGFGHG

SEQ ID NO: 1391078 - protein, 9 aa, Homo Sapiens
KAKEFLGSP

SEQ ID NO: 1391079 - protein, 9 aa, Homo Sapiens
WKLTSSTSN

SEQ ID NO: 1391080 - protein, 9 aa, Homo Sapiens
KVGTASRDI

SEQ ID NO: 1391081 - protein, 9 aa, Homo Sapiens
SPSARWQYC

SEQ ID NO: 1391082 - protein, 9 aa, Homo Sapiens
AAASRLPRM

SEQ ID NO: 1391083 - protein, 9 aa, Homo Sapiens
AIAIKLGSS

SEQ ID NO: 1391084 - protein, 9 aa, Homo Sapiens
ALKSSMEVY

SEQ ID NO: 1391085 - protein, 9 aa, Homo Sapiens
VQQPPYFPL

SEQ ID NO: 1391086 - protein, 9 aa, Homo Sapiens
VNTAWKTKK

SEQ ID NO: 1391087 - protein, 9 aa, Homo Sapiens
TCVSSTTTG

SEQ ID NO: 1391088 - protein, 9 aa, Homo Sapiens
QAIACDALS

SEQ ID NO: 1391089 - protein, 9 aa, Homo Sapiens
DLFTPLHHP

SEQ ID NO: 1391090 - protein, 9 aa, Homo Sapiens
KMILTKQIK

SEQ ID NO: 1391091 - protein, 9 aa, Homo Sapiens
LVSITSIFL

SEQ ID NO: 1391092 - protein, 9 aa, Homo Sapiens
YFIPQEAVC

SEQ ID NO: 1391093 - protein, 9 aa, Homo Sapiens
YWGNCRPIR

SEQ ID NO: 1391094 - protein, 9 aa, Homo Sapiens
DNSAQKNEC

SEQ ID NO: 1391095 - protein, 9 aa, Homo Sapiens
EELQPALTL

SEQ ID NO: 1391096 - protein, 9 aa, Homo Sapiens
KKYPEAVCV

SEQ ID NO: 1391097 - protein, 9 aa, Homo Sapiens
VFMKMEFRT

SEQ ID NO: 1391098 - protein, 9 aa, Homo Sapiens
FIFDGRHVL

SEQ ID NO: 1391099 - protein, 9 aa, Homo Sapiens
PQSPPMDLP

SEQ ID NO: 1391100 - protein, 9 aa, Homo Sapiens
IPITVTRMR

SEQ ID NO: 1391101 - protein, 9 aa, Homo Sapiens
DVFLCCGKV

SEQ ID NO: 1391102 - protein, 9 aa, Homo Sapiens
MIPQNVRRI

SEQ ID NO: 1391103 - protein, 9 aa, Homo Sapiens
HPPPAKHSS

SEQ ID NO: 1391104 - protein, 9 aa, Homo Sapiens
KPLCVKKLY

SEQ ID NO: 1391105 - protein, 9 aa, Homo Sapiens
RGSRSKTRG

SEQ ID NO: 1391106 - protein, 9 aa, Homo Sapiens
VTRMRQVRC

SEQ ID NO: 1391107 - protein, 9 aa, Homo Sapiens
STPDCTPMY

SEQ ID NO: 1391108 - protein, 9 aa, Homo Sapiens
DMYVKVFYA

SEQ ID NO: 1391109 - protein, 9 aa, Homo Sapiens
NLKELRESI

SEQ ID NO: 1391110 - protein, 9 aa, Homo Sapiens
SALTLGATS

SEQ ID NO: 1391111 - protein, 9 aa, Homo Sapiens
VVQKLRVLD

SEQ ID NO: 1391112 - protein, 9 aa, Homo Sapiens
SALIAGSSL

SEQ ID NO: 1391113 - protein, 9 aa, Homo Sapiens
NLLSPHTSY

SEQ ID NO: 1391114 - protein, 9 aa, Homo Sapiens
QAHKLWMIV

SEQ ID NO: 1391115 - protein, 9 aa, Homo Sapiens
LNNPPGVLA

SEQ ID NO: 1391116 - protein, 9 aa, Homo Sapiens
ANGFMKKSH

SEQ ID NO: 1391117 - protein, 9 aa, Homo Sapiens
EAAASRLPR

SEQ ID NO: 1391118 - protein, 9 aa, Homo Sapiens
DVMFISDDE

SEQ ID NO: 1391119 - protein, 9 aa, Homo Sapiens
GEDYFHIYT

SEQ ID NO: 1391120 - protein, 9 aa, Homo Sapiens
RRGRAGPAA

SEQ ID NO: 1391121 - protein, 9 aa, Homo Sapiens
PEDSTSKGD

SEQ ID NO: 1391122 - protein, 9 aa, Homo Sapiens
MDATLRKKA

SEQ ID NO: 1391123 - protein, 9 aa, Homo Sapiens
AFVTLASQF

SEQ ID NO: 1391124 - protein, 9 aa, Homo Sapiens
GCTSSSMSS

SEQ ID NO: 1391125 - protein, 9 aa, Homo Sapiens
LPYPFHVLA

SEQ ID NO: 1391126 - protein, 9 aa, Homo Sapiens
FAPRGLHKR

SEQ ID NO: 1391127 - protein, 9 aa, Homo Sapiens
SSWRRAPAV

SEQ ID NO: 1391128 - protein, 9 aa, Homo Sapiens
STGSHASTH

SEQ ID NO: 1391129 - protein, 9 aa, Homo Sapiens
YLGEERYGG

SEQ ID NO: 1391130 - protein, 9 aa, Homo Sapiens
IQIIEQSRR

SEQ ID NO: 1391131 - protein, 9 aa, Homo Sapiens
LVRDCLPTD

SEQ ID NO: 1391132 - protein, 9 aa, Homo Sapiens
ETVNREPFT

SEQ ID NO: 1391133 - protein, 9 aa, Homo Sapiens
SAPVSGGQF

SEQ ID NO: 1391134 - protein, 9 aa, Homo Sapiens
MGLCVDMNA

SEQ ID NO: 1391135 - protein, 9 aa, Homo Sapiens
QKSISLYWG

SEQ ID NO: 1391136 - protein, 9 aa, Homo Sapiens
TEPVIPKDE

SEQ ID NO: 1391137 - protein, 9 aa, Homo Sapiens
IKPCYYSSL

SEQ ID NO: 1391138 - protein, 9 aa, Homo Sapiens
LWLSWRRSR

SEQ ID NO: 1391139 - protein, 9 aa, Homo Sapiens
AEVMKTRTC

SEQ ID NO: 1391140 - protein, 9 aa, Homo Sapiens
HAVHHCSSR

SEQ ID NO: 1391141 - protein, 9 aa, Homo Sapiens
LELFHCLNE

SEQ ID NO: 1391142 - protein, 9 aa, Homo Sapiens
ELSKKRKPK

SEQ ID NO: 1391143 - protein, 9 aa, Homo Sapiens
NNFRLRGYS

SEQ ID NO: 1391144 - protein, 9 aa, Homo Sapiens
ARHALSWSY

SEQ ID NO: 1391145 - protein, 9 aa, Homo Sapiens
IQHSITTQD

SEQ ID NO: 1391146 - protein, 9 aa, Homo Sapiens
VVTPAQDGP

SEQ ID NO: 1391147 - protein, 9 aa, Homo Sapiens
CLDFLWRVQ

SEQ ID NO: 1391148 - protein, 9 aa, Homo Sapiens
NPTISCPFQ

SEQ ID NO: 1391149 - protein, 9 aa, Homo Sapiens
AAGDYDVEK

SEQ ID NO: 1391150 - protein, 9 aa, Homo Sapiens
KTRGKNFRK

SEQ ID NO: 1391151 - protein, 9 aa, Homo Sapiens
TLQLGMRVR

SEQ ID NO: 1391152 - protein, 9 aa, Homo Sapiens
PCIELIERL

SEQ ID NO: 1391153 - protein, 9 aa, Homo Sapiens
SCCYVRLSA

SEQ ID NO: 1391154 - protein, 9 aa, Homo Sapiens
HEMVTFKDV

SEQ ID NO: 1391155 - protein, 9 aa, Homo Sapiens
VFETLPGRV

SEQ ID NO: 1391156 - protein, 9 aa, Homo Sapiens
PGTAMPQMQ

SEQ ID NO: 1391157 - protein, 9 aa, Homo Sapiens
ALQPPGGCH

SEQ ID NO: 1391158 - protein, 9 aa, Homo Sapiens
RLSAVGLST

SEQ ID NO: 1391159 - protein, 9 aa, Homo Sapiens
VSLLGLLIL

SEQ ID NO: 1391160 - protein, 9 aa, Homo Sapiens
SQEATRRYG

SEQ ID NO: 1391161 - protein, 9 aa, Homo Sapiens
PHYIRRHPG

SEQ ID NO: 1391162 - protein, 9 aa, Homo Sapiens
CPAVPAAAC

SEQ ID NO: 1391163 - protein, 9 aa, Homo Sapiens
IDDGWMYDT

SEQ ID NO: 1391164 - protein, 9 aa, Homo Sapiens
ATSQVTSSG

SEQ ID NO: 1391165 - protein, 9 aa, Homo Sapiens
PPNYSMVLQ

SEQ ID NO: 1391166 - protein, 9 aa, Homo Sapiens
LRFVASLWG

SEQ ID NO: 1391167 - protein, 9 aa, Homo Sapiens
AAVLECLTA

SEQ ID NO: 1391168 - protein, 9 aa, Homo Sapiens
TFNNLTRLD

SEQ ID NO: 1391169 - protein, 9 aa, Homo Sapiens
PMSLACSIT

SEQ ID NO: 1391170 - protein, 9 aa, Homo Sapiens
TEFEQQEWL

SEQ ID NO: 1391171 - protein, 9 aa, Homo Sapiens
QFLRSVFET

SEQ ID NO: 1391172 - protein, 9 aa, Homo Sapiens
SSMEVYAWA

SEQ ID NO: 1391173 - protein, 9 aa, Homo Sapiens
GWEEEDDVE

SEQ ID NO: 1391174 - protein, 9 aa, Homo Sapiens
FASTYITLK

SEQ ID NO: 1391175 - protein, 9 aa, Homo Sapiens
RRGAESMTE

SEQ ID NO: 1391176 - protein, 9 aa, Homo Sapiens
RPTAIRQTL

SEQ ID NO: 1391177 - protein, 9 aa, Homo Sapiens
PSRPCRMRL

SEQ ID NO: 1391178 - protein, 9 aa, Homo Sapiens
WMSESPEQQ

SEQ ID NO: 1391179 - protein, 9 aa, Homo Sapiens
AIRQHSLGP

SEQ ID NO: 1391180 - protein, 9 aa, Homo Sapiens
TYEDPYWKE

SEQ ID NO: 1391181 - protein, 9 aa, Homo Sapiens
TTVSYEIQI

SEQ ID NO: 1391182 - protein, 9 aa, Homo Sapiens
PRAYQSTSG

SEQ ID NO: 1391183 - protein, 9 aa, Homo Sapiens
VNFLCGRHM

SEQ ID NO: 1391184 - protein, 9 aa, Homo Sapiens
LLVIATGNR

SEQ ID NO: 1391185 - protein, 9 aa, Homo Sapiens
GHKINDPWK

SEQ ID NO: 1391186 - protein, 9 aa, Homo Sapiens
GPEALSFTK

SEQ ID NO: 1391187 - protein, 9 aa, Homo Sapiens
SSNSSSDSD

SEQ ID NO: 1391188 - protein, 9 aa, Homo Sapiens
WWRGNTRKQ

SEQ ID NO: 1391189 - protein, 9 aa, Homo Sapiens
LPPGAPFLR

SEQ ID NO: 1391190 - protein, 9 aa, Homo Sapiens
PKDRYVTPW

SEQ ID NO: 1391191 - protein, 9 aa, Homo Sapiens
VLVTGQNST

SEQ ID NO: 1391192 - protein, 9 aa, Homo Sapiens
LPLVTRPPA

SEQ ID NO: 1391193 - protein, 9 aa, Homo Sapiens
NKDMLVNQP

SEQ ID NO: 1391194 - protein, 9 aa, Homo Sapiens
DGSITRDDN

SEQ ID NO: 1391195 - protein, 9 aa, Homo Sapiens
IIYIFPAVA

SEQ ID NO: 1391196 - protein, 9 aa, Homo Sapiens
LVVRLGLQA

SEQ ID NO: 1391197 - protein, 9 aa, Homo Sapiens
GVGETPGAV

SEQ ID NO: 1391198 - protein, 9 aa, Homo Sapiens
RPTSGPATM

SEQ ID NO: 1391199 - protein, 9 aa, Homo Sapiens
PGPGKPTLS

SEQ ID NO: 1391200 - protein, 9 aa, Homo Sapiens
SFLLNNFLK

SEQ ID NO: 1391201 - protein, 9 aa, Homo Sapiens
SGARHGRFR

SEQ ID NO: 1391202 - protein, 9 aa, Homo Sapiens
LEVTFPPGT

SEQ ID NO: 1391203 - protein, 9 aa, Homo Sapiens
KRKKREKII

SEQ ID NO: 1391204 - protein, 9 aa, Homo Sapiens
LILKFLCLK

SEQ ID NO: 1391205 - protein, 9 aa, Homo Sapiens
ADAREDHSR

SEQ ID NO: 1391206 - protein, 9 aa, Homo Sapiens
LTLLMLPPI

SEQ ID NO: 1391207 - protein, 9 aa, Homo Sapiens
FTSTAHVHI

SEQ ID NO: 1391208 - protein, 9 aa, Homo Sapiens
RDNLVVVEG

SEQ ID NO: 1391209 - protein, 9 aa, Homo Sapiens
WSLWLSWRR

SEQ ID NO: 1391210 - protein, 9 aa, Homo Sapiens
SSQCTQGRR

SEQ ID NO: 1391211 - protein, 9 aa, Homo Sapiens
WSLWLSWRW

SEQ ID NO: 1391212 - protein, 9 aa, Homo Sapiens
RRWGTLGLV

SEQ ID NO: 1391213 - protein, 9 aa, Homo Sapiens
AHRLEHGDG

SEQ ID NO: 1391214 - protein, 9 aa, Homo Sapiens
GGGACATCS

SEQ ID NO: 1391215 - protein, 9 aa, Homo Sapiens
HHMRTHTGE

SEQ ID NO: 1391216 - protein, 9 aa, Homo Sapiens
TLPLPLVTR

SEQ ID NO: 1391217 - protein, 9 aa, Homo Sapiens
LAPPQCPQA

SEQ ID NO: 1391218 - protein, 9 aa, Homo Sapiens
EYRLLLKHL

SEQ ID NO: 1391219 - protein, 9 aa, Homo Sapiens
AGPGRSQVS

SEQ ID NO: 1391220 - protein, 9 aa, Homo Sapiens
KHLFRELMG

SEQ ID NO: 1391221 - protein, 9 aa, Homo Sapiens
GTSHQPAAP

SEQ ID NO: 1391222 - protein, 9 aa, Homo Sapiens
LSWRRSRTS

SEQ ID NO: 1391223 - protein, 9 aa, Homo Sapiens
EVETAARGI

SEQ ID NO: 1391224 - protein, 9 aa, Homo Sapiens
TAPDLVLNV

SEQ ID NO: 1391225 - protein, 9 aa, Homo Sapiens
EEAEEDDDE

SEQ ID NO: 1391226 - protein, 9 aa, Homo Sapiens
KSQLDAANL

SEQ ID NO: 1391227 - protein, 9 aa, Homo Sapiens
VSYAGSARV

SEQ ID NO: 1391228 - protein, 9 aa, Homo Sapiens
KKPGGAARD

SEQ ID NO: 1391229 - protein, 9 aa, Homo Sapiens
LPPEPGDPD

SEQ ID NO: 1391230 - protein, 9 aa, Homo Sapiens
LFCGCAERV

SEQ ID NO: 1391231 - protein, 9 aa, Homo Sapiens
EKGWSPTPG

SEQ ID NO: 1391232 - protein, 9 aa, Homo Sapiens
VETTFCATL

SEQ ID NO: 1391233 - protein, 9 aa, Homo Sapiens
IDFEDPARP

SEQ ID NO: 1391234 - protein, 9 aa, Homo Sapiens
RIASIKPII

SEQ ID NO: 1391235 - protein, 9 aa, Homo Sapiens
ILVAWDPVP

SEQ ID NO: 1391236 - protein, 9 aa, Homo Sapiens
FNREKMPLM

SEQ ID NO: 1391237 - protein, 9 aa, Homo Sapiens
TAKKVYVTS

SEQ ID NO: 1391238 - protein, 9 aa, Homo Sapiens
WSPWASSAP

SEQ ID NO: 1391239 - protein, 9 aa, Homo Sapiens
WDPVPYSAN

SEQ ID NO: 1391240 - protein, 9 aa, Homo Sapiens
QSKMYHCDM

SEQ ID NO: 1391241 - protein, 9 aa, Homo Sapiens
SWRGLHSFY

SEQ ID NO: 1391242 - protein, 9 aa, Homo Sapiens
RSQQLHHGS

SEQ ID NO: 1391243 - protein, 9 aa, Homo Sapiens
GPGLSQEAT

SEQ ID NO: 1391244 - protein, 9 aa, Homo Sapiens
LGCSMQMRR

SEQ ID NO: 1391245 - protein, 9 aa, Homo Sapiens
LWLSWRWGT

SEQ ID NO: 1391246 - protein, 9 aa, Homo Sapiens
ALAGFGHGL

SEQ ID NO: 1391247 - protein, 9 aa, Homo Sapiens
SVELMDHKT

SEQ ID NO: 1391248 - protein, 9 aa, Homo Sapiens
QWLRATWGS

SEQ ID NO: 1391249 - protein, 9 aa, Homo Sapiens
NTALHITSL

SEQ ID NO: 1391250 - protein, 9 aa, Homo Sapiens
SLQTEGGFW

SEQ ID NO: 1391251 - protein, 9 aa, Homo Sapiens
PEMAVKLHP

SEQ ID NO: 1391252 - protein, 9 aa, Homo Sapiens
LEYTACLDF

SEQ ID NO: 1391253 - protein, 9 aa, Homo Sapiens
YVRVGKGNV

SEQ ID NO: 1391254 - protein, 9 aa, Homo Sapiens
CCGRAPSSP

SEQ ID NO: 1391255 - protein, 9 aa, Homo Sapiens
RISSSVLVA

SEQ ID NO: 1391256 - protein, 9 aa, Homo Sapiens
NINPEENDT

SEQ ID NO: 1391257 - protein, 9 aa, Homo Sapiens
YKEVVAQYQ

SEQ ID NO: 1391258 - protein, 9 aa, Homo Sapiens
HCKGRIHLT

SEQ ID NO: 1391259 - protein, 9 aa, Homo Sapiens
RDLTYSVKQ

SEQ ID NO: 1391260 - protein, 9 aa, Homo Sapiens
FSSPRISVC

SEQ ID NO: 1391261 - protein, 9 aa, Homo Sapiens
MKKSHIKWI

SEQ ID NO: 1391262 - protein, 9 aa, Homo Sapiens
WKVTVTPRE

SEQ ID NO: 1391263 - protein, 9 aa, Homo Sapiens
IEIHVSVEF

SEQ ID NO: 1391264 - protein, 9 aa, Homo Sapiens
QEAVCVAGV

SEQ ID NO: 1391265 - protein, 9 aa, Homo Sapiens
KCVLETELV

SEQ ID NO: 1391266 - protein, 9 aa, Homo Sapiens
GLTGEQTHW

SEQ ID NO: 1391267 - protein, 9 aa, Homo Sapiens
KVHITVLAV

SEQ ID NO: 1391268 - protein, 9 aa, Homo Sapiens
GCVEIGSQQ

SEQ ID NO: 1391269 - protein, 9 aa, Homo Sapiens
KVLRDGAGR

SEQ ID NO: 1391270 - protein, 9 aa, Homo Sapiens
QVSGGPPTS

SEQ ID NO: 1391271 - protein, 9 aa, Homo Sapiens
TMENCFYLH

SEQ ID NO: 1391272 - protein, 9 aa, Homo Sapiens
PEDGVNPAV

SEQ ID NO: 1391273 - protein, 9 aa, Homo Sapiens
STTTPPHCS

SEQ ID NO: 1391274 - protein, 9 aa, Homo Sapiens
RSLILKRKG

SEQ ID NO: 1391275 - protein, 9 aa, Homo Sapiens
QGMLMAGSV

SEQ ID NO: 1391276 - protein, 9 aa, Homo Sapiens
LDLVLSLPR

SEQ ID NO: 1391277 - protein, 9 aa, Homo Sapiens
PSCLTPSRW

SEQ ID NO: 1391278 - protein, 9 aa, Homo Sapiens
TQMQSFGMK

SEQ ID NO: 1391279 - protein, 9 aa, Homo Sapiens
SQQQLYRPL

SEQ ID NO: 1391280 - protein, 9 aa, Homo Sapiens
HHPAPESLE

SEQ ID NO: 1391281 - protein, 9 aa, Homo Sapiens
CTLLPKDRY

SEQ ID NO: 1391282 - protein, 9 aa, Homo Sapiens
PIEWEIRLA

SEQ ID NO: 1391283 - protein, 9 aa, Homo Sapiens
SVLQGHVYR

SEQ ID NO: 1391284 - protein, 9 aa, Homo Sapiens
KRPMGLSRP

SEQ ID NO: 1391285 - protein, 9 aa, Homo Sapiens
RRQSRHSRN

SEQ ID NO: 1391286 - protein, 9 aa, Homo Sapiens
LCGATFETT

SEQ ID NO: 1391287 - protein, 9 aa, Homo Sapiens
FLCGRHMCS

SEQ ID NO: 1391288 - protein, 9 aa, Homo Sapiens
GPVMVYQTK

SEQ ID NO: 1391289 - protein, 9 aa, Homo Sapiens
PPELVSALT

SEQ ID NO: 1391290 - protein, 9 aa, Homo Sapiens
VTANITATR

SEQ ID NO: 1391291 - protein, 9 aa, Homo Sapiens
TRKHIIIPL

SEQ ID NO: 1391292 - protein, 9 aa, Homo Sapiens
SSGSLGRCG

SEQ ID NO: 1391293 - protein, 9 aa, Homo Sapiens
GASGARHGR

SEQ ID NO: 1391294 - protein, 9 aa, Homo Sapiens
RAALKSARD

SEQ ID NO: 1391295 - protein, 9 aa, Homo Sapiens
ARAAALQSG

SEQ ID NO: 1391296 - protein, 9 aa, Homo Sapiens
SNCSITSIR

SEQ ID NO: 1391297 - protein, 9 aa, Homo Sapiens
SSDTFFNSP

SEQ ID NO: 1391298 - protein, 9 aa, Homo Sapiens
WYTVRVPGS

SEQ ID NO: 1391299 - protein, 9 aa, Homo Sapiens
RGSRVLDCA

SEQ ID NO: 1391300 - protein, 9 aa, Homo Sapiens
RVTDCTGLG

SEQ ID NO: 1391301 - protein, 9 aa, Homo Sapiens
VGHLASDFA

SEQ ID NO: 1391302 - protein, 9 aa, Homo Sapiens
QQQQQQQSQ

SEQ ID NO: 1391303 - protein, 9 aa, Homo Sapiens
GPKGGLQEN

SEQ ID NO: 1391304 - protein, 9 aa, Homo Sapiens
DSLCSSERA

SEQ ID NO: 1391305 - protein, 9 aa, Homo Sapiens
RGVARSEGK

SEQ ID NO: 1391306 - protein, 9 aa, Homo Sapiens
PKQPDLRGR

SEQ ID NO: 1391307 - protein, 9 aa, Homo Sapiens
STSSFEQHQ

SEQ ID NO: 1391308 - protein, 9 aa, Homo Sapiens
SDTFFNSPK

SEQ ID NO: 1391309 - protein, 9 aa, Homo Sapiens
VVKVTATGQ

SEQ ID NO: 1391310 - protein, 9 aa, Homo Sapiens
RGVGETPGA

SEQ ID NO: 1391311 - protein, 9 aa, Homo Sapiens
AVMIPQNVR

SEQ ID NO: 1391312 - protein, 9 aa, Homo Sapiens
TLTVSFLKE

SEQ ID NO: 1391313 - protein, 9 aa, Homo Sapiens
MIVIIKDIF

SEQ ID NO: 1391314 - protein, 9 aa, Homo Sapiens
FVTFYSGDV

SEQ ID NO: 1391315 - protein, 9 aa, Homo Sapiens
ATAWPHLTE

SEQ ID NO: 1391316 - protein, 9 aa, Homo Sapiens
KALKKKPLH

SEQ ID NO: 1391317 - protein, 9 aa, Homo Sapiens
RLWDWAPRQ

SEQ ID NO: 1391318 - protein, 9 aa, Homo Sapiens
DDDEEEEEM

SEQ ID NO: 1391319 - protein, 9 aa, Homo Sapiens
GGRILLQRN

SEQ ID NO: 1391320 - protein, 9 aa, Homo Sapiens
ETAARGIKE

SEQ ID NO: 1391321 - protein, 9 aa, Homo Sapiens
ARAPTKQPP

SEQ ID NO: 1391322 - protein, 9 aa, Homo Sapiens
VVEIVLVDD

SEQ ID NO: 1391323 - protein, 9 aa, Homo Sapiens
KLFSFQMHI

SEQ ID NO: 1391324 - protein, 9 aa, Homo Sapiens
RRILINLMK

SEQ ID NO: 1391325 - protein, 9 aa, Homo Sapiens
TPAEYRYSM

SEQ ID NO: 1391326 - protein, 9 aa, Homo Sapiens
LPMTSRYND

SEQ ID NO: 1391327 - protein, 9 aa, Homo Sapiens
PHHMRTHTG

SEQ ID NO: 1391328 - protein, 9 aa, Homo Sapiens
SLYWGNCRP

SEQ ID NO: 1391329 - protein, 9 aa, Homo Sapiens
LGKKMTASS

SEQ ID NO: 1391330 - protein, 9 aa, Homo Sapiens
RKCAEGEMR

SEQ ID NO: 1391331 - protein, 9 aa, Homo Sapiens
FCLKIYDME

SEQ ID NO: 1391332 - protein, 9 aa, Homo Sapiens
KRIERLTIR

SEQ ID NO: 1391333 - protein, 9 aa, Homo Sapiens
RRRRNQSQN

SEQ ID NO: 1391334 - protein, 9 aa, Homo Sapiens
STLSQPPPQ

SEQ ID NO: 1391335 - protein, 9 aa, Homo Sapiens
FLCCGKVSF

SEQ ID NO: 1391336 - protein, 9 aa, Homo Sapiens
ACSIAMDAT

SEQ ID NO: 1391337 - protein, 9 aa, Homo Sapiens
LPFEVVLQN

SEQ ID NO: 1391338 - protein, 9 aa, Homo Sapiens
MKLRRAALK

SEQ ID NO: 1391339 - protein, 9 aa, Homo Sapiens
TKYLNCIRI

SEQ ID NO: 1391340 - protein, 9 aa, Homo Sapiens
WMTWSVRIT

SEQ ID NO: 1391341 - protein, 9 aa, Homo Sapiens
WYRGPTPSP

SEQ ID NO: 1391342 - protein, 9 aa, Homo Sapiens
NPMWPERIH

SEQ ID NO: 1391343 - protein, 9 aa, Homo Sapiens
VVSLWGWSL

SEQ ID NO: 1391344 - protein, 9 aa, Homo Sapiens
YLHISQAMR

SEQ ID NO: 1391345 - protein, 9 aa, Homo Sapiens
KLLDYTKKP

SEQ ID NO: 1391346 - protein, 9 aa, Homo Sapiens
ERKYAPRLA

SEQ ID NO: 1391347 - protein, 9 aa, Homo Sapiens
SQPPPQAPS

SEQ ID NO: 1391348 - protein, 9 aa, Homo Sapiens
LLSLYSVAV

SEQ ID NO: 1391349 - protein, 9 aa, Homo Sapiens
PGHSLETGA

SEQ ID NO: 1391350 - protein, 9 aa, Homo Sapiens
RVNTAWKTK

SEQ ID NO: 1391351 - protein, 9 aa, Homo Sapiens
LWCGHELPG

SEQ ID NO: 1391352 - protein, 9 aa, Homo Sapiens
IPSAPWMPC

SEQ ID NO: 1391353 - protein, 9 aa, Homo Sapiens
VGVKIVMCW

SEQ ID NO: 1391354 - protein, 9 aa, Homo Sapiens
KFTHFYLDQ

SEQ ID NO: 1391355 - protein, 9 aa, Homo Sapiens
YNGIPSLTS

SEQ ID NO: 1391356 - protein, 9 aa, Homo Sapiens
QDKEKEKEQ

SEQ ID NO: 1391357 - protein, 9 aa, Homo Sapiens
QDQWFSTPW

SEQ ID NO: 1391358 - protein, 9 aa, Homo Sapiens
LFTSTAHVH

SEQ ID NO: 1391359 - protein, 9 aa, Homo Sapiens
ITSLAGQAE

SEQ ID NO: 1391360 - protein, 9 aa, Homo Sapiens
VEVPKDNKS

SEQ ID NO: 1391361 - protein, 9 aa, Homo Sapiens
NTPPTCPRA

SEQ ID NO: 1391362 - protein, 9 aa, Homo Sapiens
GLRLIIPVE

SEQ ID NO: 1391363 - protein, 9 aa, Homo Sapiens
AEDPCFIFN

SEQ ID NO: 1391364 - protein, 9 aa, Homo Sapiens
HALSHGPLG

SEQ ID NO: 1391365 - protein, 9 aa, Homo Sapiens
ILRFCFKLM

SEQ ID NO: 1391366 - protein, 9 aa, Homo Sapiens
NPCLILVVC

SEQ ID NO: 1391367 - protein, 9 aa, Homo Sapiens
LARKHSEVM

SEQ ID NO: 1391368 - protein, 9 aa, Homo Sapiens
SAAGAQPAS

SEQ ID NO: 1391369 - protein, 9 aa, Homo Sapiens
EHLLSSNSH

SEQ ID NO: 1391370 - protein, 9 aa, Homo Sapiens
NNGGGGACA

SEQ ID NO: 1391371 - protein, 9 aa, Homo Sapiens
TTSSLVASS

SEQ ID NO: 1391372 - protein, 9 aa, Homo Sapiens
MLQNAQVHQ

SEQ ID NO: 1391373 - protein, 9 aa, Homo Sapiens
RQQNELKKT

SEQ ID NO: 1391374 - protein, 9 aa, Homo Sapiens
GPCIGEESG

SEQ ID NO: 1391375 - protein, 9 aa, Homo Sapiens
SPFRIQHMD

SEQ ID NO: 1391376 - protein, 9 aa, Homo Sapiens
SRMGVVPPS

SEQ ID NO: 1391377 - protein, 9 aa, Homo Sapiens
RQSFGPVMV

SEQ ID NO: 1391378 - protein, 9 aa, Homo Sapiens
FGIRWDTII

SEQ ID NO: 1391379 - protein, 9 aa, Homo Sapiens
YIAVRTVRT

SEQ ID NO: 1391380 - protein, 9 aa, Homo Sapiens
RRSRTSGLV

SEQ ID NO: 1391381 - protein, 9 aa, Homo Sapiens
PQAVDGWVE

SEQ ID NO: 1391382 - protein, 9 aa, Homo Sapiens
LAKPFSQLY

SEQ ID NO: 1391383 - protein, 9 aa, Homo Sapiens
GILEHYVLY

SEQ ID NO: 1391384 - protein, 9 aa, Homo Sapiens
LALEVTFPP

SEQ ID NO: 1391385 - protein, 9 aa, Homo Sapiens
LVFTFASTY

SEQ ID NO: 1391386 - protein, 9 aa, Homo Sapiens
EGTWDQDGK

SEQ ID NO: 1391387 - protein, 9 aa, Homo Sapiens
IWINTPEQM

SEQ ID NO: 1391388 - protein, 9 aa, Homo Sapiens
AAPPWLHRL

SEQ ID NO: 1391389 - protein, 9 aa, Homo Sapiens
GTTVSYEIQ

SEQ ID NO: 1391390 - protein, 9 aa, Homo Sapiens
FELVTSETS

SEQ ID NO: 1391391 - protein, 9 aa, Homo Sapiens
FYYSTRYIY

SEQ ID NO: 1391392 - protein, 9 aa, Homo Sapiens
LQDAEWCWG

SEQ ID NO: 1391393 - protein, 9 aa, Homo Sapiens
SAVVKGMNS

SEQ ID NO: 1391394 - protein, 9 aa, Homo Sapiens
NAIESLDGI

SEQ ID NO: 1391395 - protein, 9 aa, Homo Sapiens
FAVCHVDAT

SEQ ID NO: 1391396 - protein, 9 aa, Homo Sapiens
MTTAAKRKW

SEQ ID NO: 1391397 - protein, 9 aa, Homo Sapiens
SAMSQPASS

SEQ ID NO: 1391398 - protein, 9 aa, Homo Sapiens
RHALSWSYD

SEQ ID NO: 1391399 - protein, 9 aa, Homo Sapiens
HALSKLKKN

SEQ ID NO: 1391400 - protein, 9 aa, Homo Sapiens
NENVINVQD

SEQ ID NO: 1391401 - protein, 9 aa, Homo Sapiens
VAAPPLTNT

SEQ ID NO: 1391402 - protein, 9 aa, Homo Sapiens
SPWYRGPTP

SEQ ID NO: 1391403 - protein, 9 aa, Homo Sapiens
AQKKLYEEI

SEQ ID NO: 1391404 - protein, 9 aa, Homo Sapiens
VRRGRAGPA

SEQ ID NO: 1391405 - protein, 9 aa, Homo Sapiens
PANGKMHGT

SEQ ID NO: 1391406 - protein, 9 aa, Homo Sapiens
GIKIYQLQF

SEQ ID NO: 1391407 - protein, 9 aa, Homo Sapiens
DYGGGSFSS

SEQ ID NO: 1391408 - protein, 9 aa, Homo Sapiens
EGAGSRVCL

SEQ ID NO: 1391409 - protein, 9 aa, Homo Sapiens
QDAEWCWGD

SEQ ID NO: 1391410 - protein, 9 aa, Homo Sapiens
AHGAPAPPE

SEQ ID NO: 1391411 - protein, 9 aa, Homo Sapiens
NPQPTPWAE

SEQ ID NO: 1391412 - protein, 9 aa, Homo Sapiens
MRPKKCPLL

SEQ ID NO: 1391413 - protein, 9 aa, Homo Sapiens
NPAFDVTPT

SEQ ID NO: 1391414 - protein, 9 aa, Homo Sapiens
RSLGEPWRA

SEQ ID NO: 1391415 - protein, 9 aa, Homo Sapiens
LRNFIGDRN

SEQ ID NO: 1391416 - protein, 9 aa, Homo Sapiens
ELNMETLVV

SEQ ID NO: 1391417 - protein, 9 aa, Homo Sapiens
TSFSHAPPV

SEQ ID NO: 1391418 - protein, 9 aa, Homo Sapiens
KDRYVTPWT

SEQ ID NO: 1391419 - protein, 9 aa, Homo Sapiens
GSITRDDNI

SEQ ID NO: 1391420 - protein, 9 aa, Homo Sapiens
AYNGIPSLT

SEQ ID NO: 1391421 - protein, 9 aa, Homo Sapiens
CLTPSRWAP

SEQ ID NO: 1391422 - protein, 9 aa, Homo Sapiens
HPLLSFKQP

SEQ ID NO: 1391423 - protein, 9 aa, Homo Sapiens
ASSPSWAWR

SEQ ID NO: 1391424 - protein, 9 aa, Homo Sapiens
FRLASTTNK

SEQ ID NO: 1391425 - protein, 9 aa, Homo Sapiens
PPPAKHSSS

SEQ ID NO: 1391426 - protein, 9 aa, Homo Sapiens
KILSDLLAQ

SEQ ID NO: 1391427 - protein, 9 aa, Homo Sapiens
KKKDKKRRN

SEQ ID NO: 1391428 - protein, 9 aa, Homo Sapiens
GDPKIGVAI

SEQ ID NO: 1391429 - protein, 9 aa, Homo Sapiens
SYSMNPQPT

SEQ ID NO: 1391430 - protein, 9 aa, Homo Sapiens
SGRPGGEDQ

SEQ ID NO: 1391431 - protein, 9 aa, Homo Sapiens
SGFGKILSS

SEQ ID NO: 1391432 - protein, 9 aa, Homo Sapiens
GQGKKKPYE

SEQ ID NO: 1391433 - protein, 9 aa, Homo Sapiens
FRIVFQIFD

SEQ ID NO: 1391434 - protein, 9 aa, Homo Sapiens
RRLPKLKHM

SEQ ID NO: 1391435 - protein, 9 aa, Homo Sapiens
IQAHRLEHG

SEQ ID NO: 1391436 - protein, 9 aa, Homo Sapiens
EDECWTGHT

SEQ ID NO: 1391437 - protein, 9 aa, Homo Sapiens
TSLPLDMYE

SEQ ID NO: 1391438 - protein, 9 aa, Homo Sapiens
ALEKLHSEM

SEQ ID NO: 1391439 - protein, 9 aa, Homo Sapiens
TAILTGVYA

SEQ ID NO: 1391440 - protein, 9 aa, Homo Sapiens
VPPQQTRKT

SEQ ID NO: 1391441 - protein, 9 aa, Homo Sapiens
VRSKNFCLK

SEQ ID NO: 1391442 - protein, 9 aa, Homo Sapiens
SDHIKRPVN

SEQ ID NO: 1391443 - protein, 9 aa, Homo Sapiens
VRSQTNALI

SEQ ID NO: 1391444 - protein, 9 aa, Homo Sapiens
VVRLGLQAF

SEQ ID NO: 1391445 - protein, 9 aa, Homo Sapiens
KLMVLLKTN

SEQ ID NO: 1391446 - protein, 9 aa, Homo Sapiens
SFAFSFPWG

SEQ ID NO: 1391447 - protein, 9 aa, Homo Sapiens
VLRCVRLLG

SEQ ID NO: 1391448 - protein, 9 aa, Homo Sapiens
PQPTPWAEE

SEQ ID NO: 1391449 - protein, 9 aa, Homo Sapiens
HQHSLKKSR

SEQ ID NO: 1391450 - protein, 9 aa, Homo Sapiens
TSFDSALHH

SEQ ID NO: 1391451 - protein, 9 aa, Homo Sapiens
LMKPAGHFT

SEQ ID NO: 1391452 - protein, 9 aa, Homo Sapiens
PFTSPTIPI

SEQ ID NO: 1391453 - protein, 9 aa, Homo Sapiens
PFYSNSTVS

SEQ ID NO: 1391454 - protein, 9 aa, Homo Sapiens
CRVNAVEEL

SEQ ID NO: 1391455 - protein, 9 aa, Homo Sapiens
TDVQQLVYE

SEQ ID NO: 1391456 - protein, 9 aa, Homo Sapiens
SIELRIKRK

SEQ ID NO: 1391457 - protein, 9 aa, Homo Sapiens
IGEESGGVV

SEQ ID NO: 1391458 - protein, 9 aa, Homo Sapiens
PQETRSSSE

SEQ ID NO: 1391459 - protein, 9 aa, Homo Sapiens
GSISVVGMS

SEQ ID NO: 1391460 - protein, 9 aa, Homo Sapiens
RSTGGWPTS

SEQ ID NO: 1391461 - protein, 9 aa, Homo Sapiens
RDRSLSTST

SEQ ID NO: 1391462 - protein, 9 aa, Homo Sapiens
LDYTKKPLY

SEQ ID NO: 1391463 - protein, 9 aa, Homo Sapiens
PLGPKSRGP

SEQ ID NO: 1391464 - protein, 9 aa, Homo Sapiens
ATNIMCSWL

SEQ ID NO: 1391465 - protein, 9 aa, Homo Sapiens
SKSGKWGSS

SEQ ID NO: 1391466 - protein, 9 aa, Homo Sapiens
PENNGGGGA

SEQ ID NO: 1391467 - protein, 9 aa, Homo Sapiens
MEFRTSMKS

SEQ ID NO: 1391468 - protein, 9 aa, Homo Sapiens
KVTLGWGPE

SEQ ID NO: 1391469 - protein, 9 aa, Homo Sapiens
MRYVLFHPE

SEQ ID NO: 1391470 - protein, 9 aa, Homo Sapiens
DWEFMVFAD

SEQ ID NO: 1391471 - protein, 9 aa, Homo Sapiens
PTKMVEKAK

SEQ ID NO: 1391472 - protein, 9 aa, Homo Sapiens
GRSTGLTGE

SEQ ID NO: 1391473 - protein, 9 aa, Homo Sapiens
ANIWVGAQE

SEQ ID NO: 1391474 - protein, 9 aa, Homo Sapiens
SLDGGANSD

SEQ ID NO: 1391475 - protein, 9 aa, Homo Sapiens
STDMIKMLV

SEQ ID NO: 1391476 - protein, 9 aa, Homo Sapiens
TGLCLPMIV

SEQ ID NO: 1391477 - protein, 9 aa, Homo Sapiens
EMAVKLHPH

SEQ ID NO: 1391478 - protein, 9 aa, Homo Sapiens
WRKCPKHVN

SEQ ID NO: 1391479 - protein, 9 aa, Homo Sapiens
LMSPRALLT

SEQ ID NO: 1391480 - protein, 9 aa, Homo Sapiens
ACSCSHRRR

SEQ ID NO: 1391481 - protein, 9 aa, Homo Sapiens
TATSSSCST

SEQ ID NO: 1391482 - protein, 9 aa, Homo Sapiens
QFVTFYSGD

SEQ ID NO: 1391483 - protein, 9 aa, Homo Sapiens
AYEDGKLLC

SEQ ID NO: 1391484 - protein, 9 aa, Homo Sapiens
IVRRGRAGP

SEQ ID NO: 1391485 - protein, 9 aa, Homo Sapiens
KLPHHMRTH

SEQ ID NO: 1391486 - protein, 9 aa, Homo Sapiens
QTEFEQQEW

SEQ ID NO: 1391487 - protein, 9 aa, Homo Sapiens
QKTIRNQGS

SEQ ID NO: 1391488 - protein, 9 aa, Homo Sapiens
SVKDVVCKV

SEQ ID NO: 1391489 - protein, 9 aa, Homo Sapiens
PPWLHRLWW

SEQ ID NO: 1391490 - protein, 9 aa, Homo Sapiens
TLAVNMVGC

SEQ ID NO: 1391491 - protein, 9 aa, Homo Sapiens
TVHHERKYA

SEQ ID NO: 1391492 - protein, 9 aa, Homo Sapiens
PANGAPPEC

SEQ ID NO: 1391493 - protein, 9 aa, Homo Sapiens
GKSQGGRIL

SEQ ID NO: 1391494 - protein, 9 aa, Homo Sapiens
EYQLFKELG

SEQ ID NO: 1391495 - protein, 9 aa, Homo Sapiens
FYFDRNPHF

SEQ ID NO: 1391496 - protein, 9 aa, Homo Sapiens
VHGPGPCIG

SEQ ID NO: 1391497 - protein, 9 aa, Homo Sapiens
LLDANKINC

SEQ ID NO: 1391498 - protein, 9 aa, Homo Sapiens
KPANMFITA

SEQ ID NO: 1391499 - protein, 9 aa, Homo Sapiens
VPVPRKKEE

SEQ ID NO: 1391500 - protein, 9 aa, Homo Sapiens
HPSCLTPSR

SEQ ID NO: 1391501 - protein, 9 aa, Homo Sapiens
VIKCDMSVL

SEQ ID NO: 1391502 - protein, 9 aa, Homo Sapiens
ILKFLCLKK

SEQ ID NO: 1391503 - protein, 9 aa, Homo Sapiens
LNSNGLEQI

SEQ ID NO: 1391504 - protein, 9 aa, Homo Sapiens
LRPRPGQPT

SEQ ID NO: 1391505 - protein, 9 aa, Homo Sapiens
QARPRNAGI

SEQ ID NO: 1391506 - protein, 9 aa, Homo Sapiens
HVCRHFMMK

SEQ ID NO: 1391507 - protein, 9 aa, Homo Sapiens
FMNQQFRNC

SEQ ID NO: 1391508 - protein, 9 aa, Homo Sapiens
WLLAMLEQK

SEQ ID NO: 1391509 - protein, 9 aa, Homo Sapiens
WQRQPLHAV

SEQ ID NO: 1391510 - protein, 9 aa, Homo Sapiens
GGPSRCRSR

SEQ ID NO: 1391511 - protein, 9 aa, Homo Sapiens
GSGPHLPVT

SEQ ID NO: 1391512 - protein, 9 aa, Homo Sapiens
TWDLPRRRL

SEQ ID NO: 1391513 - protein, 9 aa, Homo Sapiens
GTAMPQMQL

SEQ ID NO: 1391514 - protein, 9 aa, Homo Sapiens
GPEAPSTRA

SEQ ID NO: 1391515 - protein, 9 aa, Homo Sapiens
APPAALVSW

SEQ ID NO: 1391516 - protein, 9 aa, Homo Sapiens
PSLPQEQKQ

SEQ ID NO: 1391517 - protein, 9 aa, Homo Sapiens
HQGQVLPGL

SEQ ID NO: 1391518 - protein, 9 aa, Homo Sapiens
RWAPRSTAT

SEQ ID NO: 1391519 - protein, 9 aa, Homo Sapiens
ASDDGDPPR

SEQ ID NO: 1391520 - protein, 9 aa, Homo Sapiens
KFLCLKKGR

SEQ ID NO: 1391521 - protein, 9 aa, Homo Sapiens
RPPAPPTVS

SEQ ID NO: 1391522 - protein, 9 aa, Homo Sapiens
QDSGSKPRG

SEQ ID NO: 1391523 - protein, 9 aa, Homo Sapiens
IQHMDLSNS

SEQ ID NO: 1391524 - protein, 9 aa, Homo Sapiens
LRGLWCSAE

SEQ ID NO: 1391525 - protein, 9 aa, Homo Sapiens
IRNVAKDGR

SEQ ID NO: 1391526 - protein, 9 aa, Homo Sapiens
SEEIIGEIN

SEQ ID NO: 1391527 - protein, 9 aa, Homo Sapiens
NLQKSANLW

SEQ ID NO: 1391528 - protein, 9 aa, Homo Sapiens
EKWRKCPKH

SEQ ID NO: 1391529 - protein, 9 aa, Homo Sapiens
EHPTLQAIA

SEQ ID NO: 1391530 - protein, 9 aa, Homo Sapiens
FLEPGEAAL

SEQ ID NO: 1391531 - protein, 9 aa, Homo Sapiens
LFAFTPISS

SEQ ID NO: 1391532 - protein, 9 aa, Homo Sapiens
EDMLSGKIN

SEQ ID NO: 1391533 - protein, 9 aa, Homo Sapiens
KISCVIRTP

SEQ ID NO: 1391534 - protein, 9 aa, Homo Sapiens
TPLTLAGPP

SEQ ID NO: 1391535 - protein, 9 aa, Homo Sapiens
TFASTYITL

SEQ ID NO: 1391536 - protein, 9 aa, Homo Sapiens
QEATRRYGE

SEQ ID NO: 1391537 - protein, 9 aa, Homo Sapiens
TYVNVNIRG

SEQ ID NO: 1391538 - protein, 9 aa, Homo Sapiens
QVQLDPGAG

SEQ ID NO: 1391539 - protein, 9 aa, Homo Sapiens
GKIILVFTF

SEQ ID NO: 1391540 - protein, 9 aa, Homo Sapiens
YNKINKITD

SEQ ID NO: 1391541 - protein, 9 aa, Homo Sapiens
VVKGMNSHV

SEQ ID NO: 1391542 - protein, 9 aa, Homo Sapiens
LRDGAGRYF

SEQ ID NO: 1391543 - protein, 9 aa, Homo Sapiens
LPLLLAACT

SEQ ID NO: 1391544 - protein, 9 aa, Homo Sapiens
PAHCKVLMR

SEQ ID NO: 1391545 - protein, 9 aa, Homo Sapiens
VPCVPILKS

SEQ ID NO: 1391546 - protein, 9 aa, Homo Sapiens
QFLVWPERG

SEQ ID NO: 1391547 - protein, 9 aa, Homo Sapiens
GTITEDVRV

SEQ ID NO: 1391548 - protein, 9 aa, Homo Sapiens
NAVSLTCHF

SEQ ID NO: 1391549 - protein, 9 aa, Homo Sapiens
KAIRSSPKL

SEQ ID NO: 1391550 - protein, 9 aa, Homo Sapiens
SEDGEPLSS

SEQ ID NO: 1391551 - protein, 9 aa, Homo Sapiens
TRSSLAEEQ

SEQ ID NO: 1391552 - protein, 9 aa, Homo Sapiens
YITLKRIFI

SEQ ID NO: 1391553 - protein, 9 aa, Homo Sapiens
CTTPPASPW

SEQ ID NO: 1391554 - protein, 9 aa, Homo Sapiens
PVTSQEAMP

SEQ ID NO: 1391555 - protein, 9 aa, Homo Sapiens
VVGTITEDV

SEQ ID NO: 1391556 - protein, 9 aa, Homo Sapiens
LEDRGLTSR

SEQ ID NO: 1391557 - protein, 9 aa, Homo Sapiens
SLSLQQWKR

SEQ ID NO: 1391558 - protein, 9 aa, Homo Sapiens
RLWWPHGAY

SEQ ID NO: 1391559 - protein, 9 aa, Homo Sapiens
QQSLSLQQW

SEQ ID NO: 1391560 - protein, 9 aa, Homo Sapiens
LTKMILTKQ

SEQ ID NO: 1391561 - protein, 9 aa, Homo Sapiens
PDPHLCLLA

SEQ ID NO: 1391562 - protein, 9 aa, Homo Sapiens
VELKSEEYL

SEQ ID NO: 1391563 - protein, 9 aa, Homo Sapiens
LSTLGDVYV

SEQ ID NO: 1391564 - protein, 9 aa, Homo Sapiens
MRSLGEPWR

SEQ ID NO: 1391565 - protein, 9 aa, Homo Sapiens
SILKLQRGI

SEQ ID NO: 1391566 - protein, 9 aa, Homo Sapiens
PYAFRDLNY

SEQ ID NO: 1391567 - protein, 9 aa, Homo Sapiens
ASIKPIISE

SEQ ID NO: 1391568 - protein, 9 aa, Homo Sapiens
GKAPQREAS

SEQ ID NO: 1391569 - protein, 9 aa, Homo Sapiens
IPENNGGGG

SEQ ID NO: 1391570 - protein, 9 aa, Homo Sapiens
HGDHSTDKN

SEQ ID NO: 1391571 - protein, 9 aa, Homo Sapiens
WTCHWTIVP

SEQ ID NO: 1391572 - protein, 9 aa, Homo Sapiens
SSELSKKRK

SEQ ID NO: 1391573 - protein, 9 aa, Homo Sapiens
GKVSFQPSG

SEQ ID NO: 1391574 - protein, 9 aa, Homo Sapiens
EDQRLCHGG

SEQ ID NO: 1391575 - protein, 9 aa, Homo Sapiens
APAAAPPPA

SEQ ID NO: 1391576 - protein, 9 aa, Homo Sapiens
YNVNPKILM

SEQ ID NO: 1391577 - protein, 9 aa, Homo Sapiens
CATCSWMTW

SEQ ID NO: 1391578 - protein, 9 aa, Homo Sapiens
SCSSWRRAP

SEQ ID NO: 1391579 - protein, 9 aa, Homo Sapiens
PSRGPPGPN

SEQ ID NO: 1391580 - protein, 9 aa, Homo Sapiens
VTPTTSSLV

SEQ ID NO: 1391581 - protein, 9 aa, Homo Sapiens
LVVCRENIV

SEQ ID NO: 1391582 - protein, 9 aa, Homo Sapiens
KGGLQENES

SEQ ID NO: 1391583 - protein, 9 aa, Homo Sapiens
PNMDRETKE

SEQ ID NO: 1391584 - protein, 9 aa, Homo Sapiens
DMKELVVAK

SEQ ID NO: 1391585 - protein, 9 aa, Homo Sapiens
NSKSGKWGS

SEQ ID NO: 1391586 - protein, 9 aa, Homo Sapiens
PATPQKSSM

SEQ ID NO: 1391587 - protein, 9 aa, Homo Sapiens
LLPKDRYVT

SEQ ID NO: 1391588 - protein, 9 aa, Homo Sapiens
WALMSPRAL

SEQ ID NO: 1391589 - protein, 9 aa, Homo Sapiens
HHERKYAPR

SEQ ID NO: 1391590 - protein, 9 aa, Homo Sapiens
SLSTSTEEM

SEQ ID NO: 1391591 - protein, 9 aa, Homo Sapiens
KHHYSNARG

SEQ ID NO: 1391592 - protein, 9 aa, Homo Sapiens
DDDMAMCFI

SEQ ID NO: 1391593 - protein, 9 aa, Homo Sapiens
PGRSQVSGG

SEQ ID NO: 1391594 - protein, 9 aa, Homo Sapiens
AWDPVPYSA

SEQ ID NO: 1391595 - protein, 9 aa, Homo Sapiens
YSGDVILTG

SEQ ID NO: 1391596 - protein, 9 aa, Homo Sapiens
GIDKIYVRT

SEQ ID NO: 1391597 - protein, 9 aa, Homo Sapiens
PQTAMCDLV

SEQ ID NO: 1391598 - protein, 9 aa, Homo Sapiens
VLVCVPRRP

SEQ ID NO: 1391599 - protein, 9 aa, Homo Sapiens
PNLVLDEIK

SEQ ID NO: 1391600 - protein, 9 aa, Homo Sapiens
LRSVFETLP

SEQ ID NO: 1391601 - protein, 9 aa, Homo Sapiens
GDRSKRGEK

SEQ ID NO: 1391602 - protein, 9 aa, Homo Sapiens
QKNLCPAVK

SEQ ID NO: 1391603 - protein, 9 aa, Homo Sapiens
CVGGLSVCL

SEQ ID NO: 1391604 - protein, 9 aa, Homo Sapiens
AGEGPSRCP

SEQ ID NO: 1391605 - protein, 9 aa, Homo Sapiens
KGPPPRPPS

SEQ ID NO: 1391606 - protein, 9 aa, Homo Sapiens
TCSWMTWSV

SEQ ID NO: 1391607 - protein, 9 aa, Homo Sapiens
DVIDLKKEW

SEQ ID NO: 1391608 - protein, 9 aa, Homo Sapiens
HKLCCGSSW

SEQ ID NO: 1391609 - protein, 9 aa, Homo Sapiens
ALTLEEYYS

SEQ ID NO: 1391610 - protein, 9 aa, Homo Sapiens
VTFPPGTAM

SEQ ID NO: 1391611 - protein, 9 aa, Homo Sapiens
KVILWDLLR

SEQ ID NO: 1391612 - protein, 9 aa, Homo Sapiens
EKPYECKDR

SEQ ID NO: 1391613 - protein, 9 aa, Homo Sapiens
QVWTAATLR

SEQ ID NO: 1391614 - protein, 9 aa, Homo Sapiens
YGGGSFSSN

SEQ ID NO: 1391615 - protein, 9 aa, Homo Sapiens
RMSFLLNNF

SEQ ID NO: 1391616 - protein, 9 aa, Homo Sapiens
QSLSLQQWK

SEQ ID NO: 1391617 - protein, 9 aa, Homo Sapiens
EDFLLVFSA

SEQ ID NO: 1391618 - protein, 9 aa, Homo Sapiens
EALAVHRQK

SEQ ID NO: 1391619 - protein, 9 aa, Homo Sapiens
LTAWTCHWT

SEQ ID NO: 1391620 - protein, 9 aa, Homo Sapiens
NLSTILILK

SEQ ID NO: 1391621 - protein, 9 aa, Homo Sapiens
TPRESMTLL

SEQ ID NO: 1391622 - protein, 9 aa, Homo Sapiens
SPTRCCRPR

SEQ ID NO: 1391623 - protein, 9 aa, Homo Sapiens
SHLWTLDLV

SEQ ID NO: 1391624 - protein, 9 aa, Homo Sapiens
AGVNIAVII

SEQ ID NO: 1391625 - protein, 9 aa, Homo Sapiens
SAPSSMTLT

SEQ ID NO: 1391626 - protein, 9 aa, Homo Sapiens
LYWEWPAVP

SEQ ID NO: 1391627 - protein, 9 aa, Homo Sapiens
RPRSLRPEV

SEQ ID NO: 1391628 - protein, 9 aa, Homo Sapiens
HGLHRHRGQ

SEQ ID NO: 1391629 - protein, 9 aa, Homo Sapiens
ETTNVEKRR

SEQ ID NO: 1391630 - protein, 9 aa, Homo Sapiens
LQHFTTGRL

SEQ ID NO: 1391631 - protein, 9 aa, Homo Sapiens
RPKKCPLLL

SEQ ID NO: 1391632 - protein, 9 aa, Homo Sapiens
KWKHMQETK

SEQ ID NO: 1391633 - protein, 9 aa, Homo Sapiens
VHFFVLTKA

SEQ ID NO: 1391634 - protein, 9 aa, Homo Sapiens
TQTTATCSP

SEQ ID NO: 1391635 - protein, 9 aa, Homo Sapiens
GKFLVSITS

SEQ ID NO: 1391636 - protein, 9 aa, Homo Sapiens
PWTQRTSAG

SEQ ID NO: 1391637 - protein, 9 aa, Homo Sapiens
KPFSQLYIR

SEQ ID NO: 1391638 - protein, 9 aa, Homo Sapiens
GHVRVHPDL

SEQ ID NO: 1391639 - protein, 9 aa, Homo Sapiens
NVNIRGIDK

SEQ ID NO: 1391640 - protein, 9 aa, Homo Sapiens
GILIFRDWH

SEQ ID NO: 1391641 - protein, 9 aa, Homo Sapiens
CTWDPGMDT

SEQ ID NO: 1391642 - protein, 9 aa, Homo Sapiens
RSQTNALIG

SEQ ID NO: 1391643 - protein, 9 aa, Homo Sapiens
HLPSSSDTF

SEQ ID NO: 1391644 - protein, 9 aa, Homo Sapiens
AIKLGSSKP

SEQ ID NO: 1391645 - protein, 9 aa, Homo Sapiens
WGAWHPGSW

SEQ ID NO: 1391646 - protein, 9 aa, Homo Sapiens
RLLPYPFHV

SEQ ID NO: 1391647 - protein, 9 aa, Homo Sapiens
ERGGGCLPP

SEQ ID NO: 1391648 - protein, 9 aa, Homo Sapiens
CLDERQIKI

SEQ ID NO: 1391649 - protein, 9 aa, Homo Sapiens
SEGGPEAPS

SEQ ID NO: 1391650 - protein, 9 aa, Homo Sapiens
SHMNSVKDV

SEQ ID NO: 1391651 - protein, 9 aa, Homo Sapiens
YSGTHHVVP

SEQ ID NO: 1391652 - protein, 9 aa, Homo Sapiens
TGSSREVGH

SEQ ID NO: 1391653 - protein, 9 aa, Homo Sapiens
ERRHVFGKS

SEQ ID NO: 1391654 - protein, 9 aa, Homo Sapiens
SVHCKGRIH

SEQ ID NO: 1391655 - protein, 9 aa, Homo Sapiens
NYYESKIRK

SEQ ID NO: 1391656 - protein, 9 aa, Homo Sapiens
LSLPRVPMN

SEQ ID NO: 1391657 - protein, 9 aa, Homo Sapiens
LLLTQARPR

SEQ ID NO: 1391658 - protein, 9 aa, Homo Sapiens
KREIQNSLL

SEQ ID NO: 1391659 - protein, 9 aa, Homo Sapiens
PSSPPPRPP

SEQ ID NO: 1391660 - protein, 9 aa, Homo Sapiens
SDLLAQYDS

SEQ ID NO: 1391661 - protein, 9 aa, Homo Sapiens
APAPWLPMR

SEQ ID NO: 1391662 - protein, 9 aa, Homo Sapiens
PVSGGQFRA

SEQ ID NO: 1391663 - protein, 9 aa, Homo Sapiens
FFVPMSLAC

SEQ ID NO: 1391664 - protein, 9 aa, Homo Sapiens
SGPHLPVTA

SEQ ID NO: 1391665 - protein, 9 aa, Homo Sapiens
LPWASSVLQ

SEQ ID NO: 1391666 - protein, 9 aa, Homo Sapiens
SERAGDIQT

SEQ ID NO: 1391667 - protein, 9 aa, Homo Sapiens
VGATGRRQS

SEQ ID NO: 1391668 - protein, 9 aa, Homo Sapiens
KMVTSKLPN

SEQ ID NO: 1391669 - protein, 9 aa, Homo Sapiens
SEVMLDDEE

SEQ ID NO: 1391670 - protein, 9 aa, Homo Sapiens
GLDVVAQMD

SEQ ID NO: 1391671 - protein, 9 aa, Homo Sapiens
RHHHHPLPA

SEQ ID NO: 1391672 - protein, 9 aa, Homo Sapiens
LSAVGLSTW

SEQ ID NO: 1391673 - protein, 9 aa, Homo Sapiens
KHTLSALPS

SEQ ID NO: 1391674 - protein, 9 aa, Homo Sapiens
HLMLEELRN

SEQ ID NO: 1391675 - protein, 9 aa, Homo Sapiens
KRIAEITDI

SEQ ID NO: 1391676 - protein, 9 aa, Homo Sapiens
TPMYTDVIS

SEQ ID NO: 1391677 - protein, 9 aa, Homo Sapiens
PGLEHQHSL

SEQ ID NO: 1391678 - protein, 9 aa, Homo Sapiens
DSSAVVKGM

SEQ ID NO: 1391679 - protein, 9 aa, Homo Sapiens
QNWGSLPLR

SEQ ID NO: 1391680 - protein, 9 aa, Homo Sapiens
DKSRLFRVE

SEQ ID NO: 1391681 - protein, 9 aa, Homo Sapiens
AVIIYIFPA

SEQ ID NO: 1391682 - protein, 9 aa, Homo Sapiens
VFKRAMEGQ

SEQ ID NO: 1391683 - protein, 9 aa, Homo Sapiens
IKRKKKKRP

SEQ ID NO: 1391684 - protein, 9 aa, Homo Sapiens
PAPAPWLPM

SEQ ID NO: 1391685 - protein, 9 aa, Homo Sapiens
SLRMRYVLF

SEQ ID NO: 1391686 - protein, 9 aa, Homo Sapiens
ARGSRVLDC

SEQ ID NO: 1391687 - protein, 9 aa, Homo Sapiens
ILPELGLNQ

SEQ ID NO: 1391688 - protein, 9 aa, Homo Sapiens
GDEAIKGLL

SEQ ID NO: 1391689 - protein, 9 aa, Homo Sapiens
NTFKYPREG

SEQ ID NO: 1391690 - protein, 9 aa, Homo Sapiens
WENSMLTDS

SEQ ID NO: 1391691 - protein, 9 aa, Homo Sapiens
VVLDVDTIN

SEQ ID NO: 1391692 - protein, 9 aa, Homo Sapiens
AALQSGRPG

SEQ ID NO: 1391693 - protein, 9 aa, Homo Sapiens
CGSSWYIQG

SEQ ID NO: 1391694 - protein, 9 aa, Homo Sapiens
ALQSGRPGG

SEQ ID NO: 1391695 - protein, 9 aa, Homo Sapiens
LQPALTLEE

SEQ ID NO: 1391696 - protein, 9 aa, Homo Sapiens
LYRPLVLTV

SEQ ID NO: 1391697 - protein, 9 aa, Homo Sapiens
SRISGFGTL

SEQ ID NO: 1391698 - protein, 9 aa, Homo Sapiens
SINHANLIS

SEQ ID NO: 1391699 - protein, 9 aa, Homo Sapiens
LENLQKSAN

SEQ ID NO: 1391700 - protein, 9 aa, Homo Sapiens
AQLLGMCLT

SEQ ID NO: 1391701 - protein, 9 aa, Homo Sapiens
ATFETTFPS

SEQ ID NO: 1391702 - protein, 9 aa, Homo Sapiens
GTTDRHFAG

SEQ ID NO: 1391703 - protein, 9 aa, Homo Sapiens
TLRMQRFTS

SEQ ID NO: 1391704 - protein, 9 aa, Homo Sapiens
KGWSPTPGC

SEQ ID NO: 1391705 - protein, 9 aa, Homo Sapiens
SYLMGVSVC

SEQ ID NO: 1391706 - protein, 9 aa, Homo Sapiens
SIAMDATLR

SEQ ID NO: 1391707 - protein, 9 aa, Homo Sapiens
TQPPTLGCS

SEQ ID NO: 1391708 - protein, 9 aa, Homo Sapiens
SVSISPSSA

SEQ ID NO: 1391709 - protein, 9 aa, Homo Sapiens
KVTATGQTK

SEQ ID NO: 1391710 - protein, 9 aa, Homo Sapiens
GVIAVPTSD

SEQ ID NO: 1391711 - protein, 9 aa, Homo Sapiens
QKFKQAKRG

SEQ ID NO: 1391712 - protein, 9 aa, Homo Sapiens
EDGEELATP

SEQ ID NO: 1391713 - protein, 9 aa, Homo Sapiens
LLSRDVPQE

SEQ ID NO: 1391714 - protein, 9 aa, Homo Sapiens
CIPENNGGG

SEQ ID NO: 1391715 - protein, 9 aa, Homo Sapiens
VTATGQTKR

SEQ ID NO: 1391716 - protein, 9 aa, Homo Sapiens
RILPELGLN

SEQ ID NO: 1391717 - protein, 9 aa, Homo Sapiens
FESLRMRYV

SEQ ID NO: 1391718 - protein, 9 aa, Homo Sapiens
YRGPTPSPL

SEQ ID NO: 1391719 - protein, 9 aa, Homo Sapiens
LTFRVAIRV

SEQ ID NO: 1391720 - protein, 9 aa, Homo Sapiens
ISETSLPLD

SEQ ID NO: 1391721 - protein, 9 aa, Homo Sapiens
PLHAVHHCS

SEQ ID NO: 1391722 - protein, 9 aa, Homo Sapiens
SLQNLYLLI

SEQ ID NO: 1391723 - protein, 9 aa, Homo Sapiens
APTPPSTQF

SEQ ID NO: 1391724 - protein, 9 aa, Homo Sapiens
EEIIGEINC

SEQ ID NO: 1391725 - protein, 9 aa, Homo Sapiens
YYVLFKLLW

SEQ ID NO: 1391726 - protein, 9 aa, Homo Sapiens
PATMSPWYR

SEQ ID NO: 1391727 - protein, 9 aa, Homo Sapiens
RGVILKHFR

SEQ ID NO: 1391728 - protein, 9 aa, Homo Sapiens
RLRGVILKH

SEQ ID NO: 1391729 - protein, 9 aa, Homo Sapiens
TGAPLPERA

SEQ ID NO: 1391730 - protein, 9 aa, Homo Sapiens
LATAWPHLT

SEQ ID NO: 1391731 - protein, 9 aa, Homo Sapiens
TNKEAICKA

SEQ ID NO: 1391732 - protein, 9 aa, Homo Sapiens
DRGLQGPPG

SEQ ID NO: 1391733 - protein, 9 aa, Homo Sapiens
NNSPMAANR

SEQ ID NO: 1391734 - protein, 9 aa, Homo Sapiens
MGSISVVGM

SEQ ID NO: 1391735 - protein, 9 aa, Homo Sapiens
KYAPRLAPL

SEQ ID NO: 1391736 - protein, 9 aa, Homo Sapiens
GFHDETAFF

SEQ ID NO: 1391737 - protein, 9 aa, Homo Sapiens
RLLCLEEPP

SEQ ID NO: 1391738 - protein, 9 aa, Homo Sapiens
HGGLSVAFS

SEQ ID NO: 1391739 - protein, 9 aa, Homo Sapiens
DNTSAKLKS

SEQ ID NO: 1391740 - protein, 9 aa, Homo Sapiens
ANLWGKFLV

SEQ ID NO: 1391741 - protein, 9 aa, Homo Sapiens
KISGILEHY

SEQ ID NO: 1391742 - protein, 9 aa, Homo Sapiens
CAPSNKSVD

SEQ ID NO: 1391743 - protein, 9 aa, Homo Sapiens
HCSSRKQSC

SEQ ID NO: 1391744 - protein, 9 aa, Homo Sapiens
PELGLNQEQ

SEQ ID NO: 1391745 - protein, 9 aa, Homo Sapiens
DDGWMYDTV

SEQ ID NO: 1391746 - protein, 9 aa, Homo Sapiens
EFQHLQLKE

SEQ ID NO: 1391747 - protein, 9 aa, Homo Sapiens
REDKRERTA

SEQ ID NO: 1391748 - protein, 9 aa, Homo Sapiens
PSNFKVHFF

SEQ ID NO: 1391749 - protein, 9 aa, Homo Sapiens
GDASKTLDS

SEQ ID NO: 1391750 - protein, 9 aa, Homo Sapiens
MEMLRSIMS

SEQ ID NO: 1391751 - protein, 9 aa, Homo Sapiens
RSHLWTLDL

SEQ ID NO: 1391752 - protein, 9 aa, Homo Sapiens
YLSLKDSRP

SEQ ID NO: 1391753 - protein, 9 aa, Homo Sapiens
NVSGSVSST

SEQ ID NO: 1391754 - protein, 9 aa, Homo Sapiens
AKHSSSQCT

SEQ ID NO: 1391755 - protein, 9 aa, Homo Sapiens
VGKIPDKEV

SEQ ID NO: 1391756 - protein, 9 aa, Homo Sapiens
YNIKSVCSR

SEQ ID NO: 1391757 - protein, 9 aa, Homo Sapiens
HMCSMKKTI

SEQ ID NO: 1391758 - protein, 9 aa, Homo Sapiens
VHGTSHQPA

SEQ ID NO: 1391759 - protein, 9 aa, Homo Sapiens
PYFPLKIPP

SEQ ID NO: 1391760 - protein, 9 aa, Homo Sapiens
KDHLAKPFS

SEQ ID NO: 1391761 - protein, 9 aa, Homo Sapiens
KKEEDWKCV

SEQ ID NO: 1391762 - protein, 9 aa, Homo Sapiens
LDGITNLPR

SEQ ID NO: 1391763 - protein, 9 aa, Homo Sapiens
QELLLANIW

SEQ ID NO: 1391764 - protein, 9 aa, Homo Sapiens
REVGIDDVF

SEQ ID NO: 1391765 - protein, 9 aa, Homo Sapiens
REQQQQQPL

SEQ ID NO: 1391766 - protein, 9 aa, Homo Sapiens
RQRIFITTI

SEQ ID NO: 1391767 - protein, 9 aa, Homo Sapiens
ARMTVTRRT

SEQ ID NO: 1391768 - protein, 9 aa, Homo Sapiens
LNVEMVQQT

SEQ ID NO: 1391769 - protein, 9 aa, Homo Sapiens
PGAWTLTMP

SEQ ID NO: 1391770 - protein, 9 aa, Homo Sapiens
SDGIWKVWQ

SEQ ID NO: 1391771 - protein, 9 aa, Homo Sapiens
SSCTYSALI

SEQ ID NO: 1391772 - protein, 9 aa, Homo Sapiens
GKSDELIGQ

SEQ ID NO: 1391773 - protein, 9 aa, Homo Sapiens
LWLSWRRWG

SEQ ID NO: 1391774 - protein, 9 aa, Homo Sapiens
QPLRNFIGD

SEQ ID NO: 1391775 - protein, 9 aa, Homo Sapiens
WPTAAPPTH

SEQ ID NO: 1391776 - protein, 9 aa, Homo Sapiens
QRNLLRLQS

SEQ ID NO: 1391777 - protein, 9 aa, Homo Sapiens
DHQATYTEC

SEQ ID NO: 1391778 - protein, 9 aa, Homo Sapiens
SMNPQPTPW

SEQ ID NO: 1391779 - protein, 9 aa, Homo Sapiens
QVFIQKNLC

SEQ ID NO: 1391780 - protein, 9 aa, Homo Sapiens
LLSPHTSYR

SEQ ID NO: 1391781 - protein, 9 aa, Homo Sapiens
LRRCLCADY

SEQ ID NO: 1391782 - protein, 9 aa, Homo Sapiens
AAEARAKLA

SEQ ID NO: 1391783 - protein, 9 aa, Homo Sapiens
VASSQNWGS

SEQ ID NO: 1391784 - protein, 9 aa, Homo Sapiens
HKNSYWRET

SEQ ID NO: 1391785 - protein, 9 aa, Homo Sapiens
CSTTAATSS

SEQ ID NO: 1391786 - protein, 9 aa, Homo Sapiens
TSCMWLWMS

SEQ ID NO: 1391787 - protein, 9 aa, Homo Sapiens
VFGIRWDTI

SEQ ID NO: 1391788 - protein, 9 aa, Homo Sapiens
MTEEKFTVL

SEQ ID NO: 1391789 - protein, 9 aa, Homo Sapiens
GYDGRNALW

SEQ ID NO: 1391790 - protein, 9 aa, Homo Sapiens
AIVCGVWYM

SEQ ID NO: 1391791 - protein, 9 aa, Homo Sapiens
FLKEHLLSS

SEQ ID NO: 1391792 - protein, 9 aa, Homo Sapiens
ELCRLYMQF

SEQ ID NO: 1391793 - protein, 9 aa, Homo Sapiens
TFILSCVAT

SEQ ID NO: 1391794 - protein, 9 aa, Homo Sapiens
SLVASSQNW

SEQ ID NO: 1391795 - protein, 9 aa, Homo Sapiens
LELKHWCPG

SEQ ID NO: 1391796 - protein, 9 aa, Homo Sapiens
YHQVVGAQR

SEQ ID NO: 1391797 - protein, 9 aa, Homo Sapiens
EMKYEHQKK

SEQ ID NO: 1391798 - protein, 9 aa, Homo Sapiens
MAVAAVVVP

SEQ ID NO: 1391799 - protein, 9 aa, Homo Sapiens
PPLDSTKSF

SEQ ID NO: 1391800 - protein, 9 aa, Homo Sapiens
GNRRGSVLL

SEQ ID NO: 1391801 - protein, 9 aa, Homo Sapiens
QLKKEQKKG

SEQ ID NO: 1391802 - protein, 9 aa, Homo Sapiens
TGLCGATFE

SEQ ID NO: 1391803 - protein, 9 aa, Homo Sapiens
ACCMQKSGL

SEQ ID NO: 1391804 - protein, 9 aa, Homo Sapiens
MIQTFPLHQ

SEQ ID NO: 1391805 - protein, 9 aa, Homo Sapiens
RRCQRKAQR

SEQ ID NO: 1391806 - protein, 9 aa, Homo Sapiens
VTGAYSKHT

SEQ ID NO: 1391807 - protein, 9 aa, Homo Sapiens
EEDFHLQNS

SEQ ID NO: 1391808 - protein, 9 aa, Homo Sapiens
PECCSSWLR

SEQ ID NO: 1391809 - protein, 9 aa, Homo Sapiens
LLFEVFTIW

SEQ ID NO: 1391810 - protein, 9 aa, Homo Sapiens
TSGLVVSLW

SEQ ID NO: 1391811 - protein, 9 aa, Homo Sapiens
PSELCRLYM

SEQ ID NO: 1391812 - protein, 9 aa, Homo Sapiens
SSIPNLKSV

SEQ ID NO: 1391813 - protein, 9 aa, Homo Sapiens
FNSKSGKWG

SEQ ID NO: 1391814 - protein, 9 aa, Homo Sapiens
NNVGLLGAG

SEQ ID NO: 1391815 - protein, 9 aa, Homo Sapiens
PRSLRPEVG

SEQ ID NO: 1391816 - protein, 9 aa, Homo Sapiens
GFVASPGRR

SEQ ID NO: 1391817 - protein, 9 aa, Homo Sapiens
VREQHGIQR

SEQ ID NO: 1391818 - protein, 9 aa, Homo Sapiens
KFTWATKGR

SEQ ID NO: 1391819 - protein, 9 aa, Homo Sapiens
ITSVVLVCV

SEQ ID NO: 1391820 - protein, 9 aa, Homo Sapiens
PRRRLCQTQ

SEQ ID NO: 1391821 - protein, 9 aa, Homo Sapiens
QGKLHQLIM

SEQ ID NO: 1391822 - protein, 9 aa, Homo Sapiens
SVEFQGLIQ

SEQ ID NO: 1391823 - protein, 9 aa, Homo Sapiens
ILLGICTVF

SEQ ID NO: 1391824 - protein, 9 aa, Homo Sapiens
MSSTSFLSM

SEQ ID NO: 1391825 - protein, 9 aa, Homo Sapiens
APRSTATSS

SEQ ID NO: 1391826 - protein, 9 aa, Homo Sapiens
LLANIWVGA

SEQ ID NO: 1391827 - protein, 9 aa, Homo Sapiens
SEKFTWATK

SEQ ID NO: 1391828 - protein, 9 aa, Homo Sapiens
GQMELPACA

SEQ ID NO: 1391829 - protein, 9 aa, Homo Sapiens
LQPPGGCHP

SEQ ID NO: 1391830 - protein, 9 aa, Homo Sapiens
RTAAVGKAR

SEQ ID NO: 1391831 - protein, 9 aa, Homo Sapiens
QPDPHLCLL

SEQ ID NO: 1391832 - protein, 9 aa, Homo Sapiens
VTIATAILT

SEQ ID NO: 1391833 - protein, 9 aa, Homo Sapiens
VASPGRRDP

SEQ ID NO: 1391834 - protein, 9 aa, Homo Sapiens
QHPPPAKHS

SEQ ID NO: 1391835 - protein, 9 aa, Homo Sapiens
EECSPAAPP

SEQ ID NO: 1391836 - protein, 9 aa, Homo Sapiens
SLGEPWRAG

SEQ ID NO: 1391837 - protein, 9 aa, Homo Sapiens
VVCRENIVG

SEQ ID NO: 1391838 - protein, 9 aa, Homo Sapiens
CSHRRRAKA

SEQ ID NO: 1391839 - protein, 9 aa, Homo Sapiens
ERVFTLARW

SEQ ID NO: 1391840 - protein, 9 aa, Homo Sapiens
PLEKAMLMA

SEQ ID NO: 1391841 - protein, 9 aa, Homo Sapiens
QTCTNPAPL

SEQ ID NO: 1391842 - protein, 9 aa, Homo Sapiens
IMEMLRSIM

SEQ ID NO: 1391843 - protein, 9 aa, Homo Sapiens
SKRGEKGER

SEQ ID NO: 1391844 - protein, 9 aa, Homo Sapiens
CVLETELVD

SEQ ID NO: 1391845 - protein, 9 aa, Homo Sapiens
YLRQSNQSL

SEQ ID NO: 1391846 - protein, 9 aa, Homo Sapiens
QKLRVLDRQ

SEQ ID NO: 1391847 - protein, 9 aa, Homo Sapiens
KRPEAAQLS

SEQ ID NO: 1391848 - protein, 9 aa, Homo Sapiens
AHAWLCHLV

SEQ ID NO: 1391849 - protein, 9 aa, Homo Sapiens
SSVLVATVL

SEQ ID NO: 1391850 - protein, 9 aa, Homo Sapiens
WSRLRGPGP

SEQ ID NO: 1391851 - protein, 9 aa, Homo Sapiens
TLGDVYVND

SEQ ID NO: 1391852 - protein, 9 aa, Homo Sapiens
IWHVQQLEI

SEQ ID NO: 1391853 - protein, 9 aa, Homo Sapiens
SRRRRNQSQ

SEQ ID NO: 1391854 - protein, 9 aa, Homo Sapiens
CQGQACQDQ

SEQ ID NO: 1391855 - protein, 9 aa, Homo Sapiens
CASLLSTLS

SEQ ID NO: 1391856 - protein, 9 aa, Homo Sapiens
DSEKMSRIS

SEQ ID NO: 1391857 - protein, 9 aa, Homo Sapiens
LTIYDAWFP

SEQ ID NO: 1391858 - protein, 9 aa, Homo Sapiens
RRSAHKEEE

SEQ ID NO: 1391859 - protein, 9 aa, Homo Sapiens
ENYGDVYGI

SEQ ID NO: 1391860 - protein, 9 aa, Homo Sapiens
LYWGNCRPI

SEQ ID NO: 1391861 - protein, 9 aa, Homo Sapiens
VVLVTGQNS

SEQ ID NO: 1391862 - protein, 9 aa, Homo Sapiens
KQAKRGSSP

SEQ ID NO: 1391863 - protein, 9 aa, Homo Sapiens
PAKCITAHE

SEQ ID NO: 1391864 - protein, 9 aa, Homo Sapiens
FLVCGNRRG

SEQ ID NO: 1391865 - protein, 9 aa, Homo Sapiens
SCKVRLLGP

SEQ ID NO: 1391866 - protein, 9 aa, Homo Sapiens
YIFPAVAFR

SEQ ID NO: 1391867 - protein, 9 aa, Homo Sapiens
SQRRRRYRS

SEQ ID NO: 1391868 - protein, 9 aa, Homo Sapiens
ASVGATGRR

SEQ ID NO: 1391869 - protein, 9 aa, Homo Sapiens
SQEILLLAV

SEQ ID NO: 1391870 - protein, 9 aa, Homo Sapiens
EASTPSTPV

SEQ ID NO: 1391871 - protein, 9 aa, Homo Sapiens
PQAPSQVWT

SEQ ID NO: 1391872 - protein, 9 aa, Homo Sapiens
LDGGANSDS

SEQ ID NO: 1391873 - protein, 9 aa, Homo Sapiens
PSRCRSRLE

SEQ ID NO: 1391874 - protein, 9 aa, Homo Sapiens
ALTSLHPMT

SEQ ID NO: 1391875 - protein, 9 aa, Homo Sapiens
LALAMGQTT

SEQ ID NO: 1391876 - protein, 9 aa, Homo Sapiens
FVLLLSAIV

SEQ ID NO: 1391877 - protein, 9 aa, Homo Sapiens
QGQVLPGLD

SEQ ID NO: 1391878 - protein, 9 aa, Homo Sapiens
PAAPTSWAT

SEQ ID NO: 1391879 - protein, 9 aa, Homo Sapiens
AALDDYSVS

SEQ ID NO: 1391880 - protein, 9 aa, Homo Sapiens
LDSSHTQRQ

SEQ ID NO: 1391881 - protein, 9 aa, Homo Sapiens
HCFAPRGLH

SEQ ID NO: 1391882 - protein, 9 aa, Homo Sapiens
NGGGGACAT

SEQ ID NO: 1391883 - protein, 9 aa, Homo Sapiens
QWGESPWQV

SEQ ID NO: 1391884 - protein, 9 aa, Homo Sapiens
PAQDGPCGT

SEQ ID NO: 1391885 - protein, 9 aa, Homo Sapiens
RIQHMDLSN

SEQ ID NO: 1391886 - protein, 9 aa, Homo Sapiens
KAVKSSTCP

SEQ ID NO: 1391887 - protein, 9 aa, Homo Sapiens
PHPPNYSMV

SEQ ID NO: 1391888 - protein, 9 aa, Homo Sapiens
CGRAPSSPA

SEQ ID NO: 1391889 - protein, 9 aa, Homo Sapiens
PEQMVPYGL

SEQ ID NO: 1391890 - protein, 9 aa, Homo Sapiens
SHIKWICSM

SEQ ID NO: 1391891 - protein, 9 aa, Homo Sapiens
TSHQPAAPG

SEQ ID NO: 1391892 - protein, 9 aa, Homo Sapiens
KRFLTLASA

SEQ ID NO: 1391893 - protein, 9 aa, Homo Sapiens
LLKVGTASR

SEQ ID NO: 1391894 - protein, 9 aa, Homo Sapiens
GKLGVPELL

SEQ ID NO: 1391895 - protein, 9 aa, Homo Sapiens
RTSAGCSTT

SEQ ID NO: 1391896 - protein, 9 aa, Homo Sapiens
LSDLLAQYD

SEQ ID NO: 1391897 - protein, 9 aa, Homo Sapiens
SYLDSSAYE

SEQ ID NO: 1391898 - protein, 9 aa, Homo Sapiens
TSWAIVCGV

SEQ ID NO: 1391899 - protein, 9 aa, Homo Sapiens
STTEVIRNV

SEQ ID NO: 1391900 - protein, 9 aa, Homo Sapiens
KKDKKRRNL

SEQ ID NO: 1391901 - protein, 9 aa, Homo Sapiens
SIVLSYIHI

SEQ ID NO: 1391902 - protein, 9 aa, Homo Sapiens
GMEMEEMKR

SEQ ID NO: 1391903 - protein, 9 aa, Homo Sapiens
QKHWASCSF

SEQ ID NO: 1391904 - protein, 9 aa, Homo Sapiens
SHGRERRGR

SEQ ID NO: 1391905 - protein, 9 aa, Homo Sapiens
ELHSDVEYA

SEQ ID NO: 1391906 - protein, 9 aa, Homo Sapiens
ACSHKVLAW

SEQ ID NO: 1391907 - protein, 9 aa, Homo Sapiens
KQEVAQLRR

SEQ ID NO: 1391908 - protein, 9 aa, Homo Sapiens
HGTVDCNGV

SEQ ID NO: 1391909 - protein, 9 aa, Homo Sapiens
PLRNFIGDR

SEQ ID NO: 1391910 - protein, 9 aa, Homo Sapiens
IPTVLSSSH

SEQ ID NO: 1391911 - protein, 9 aa, Homo Sapiens
TCASHFCQF

SEQ ID NO: 1391912 - protein, 9 aa, Homo Sapiens
LGMRVRMLD

SEQ ID NO: 1391913 - protein, 9 aa, Homo Sapiens
YMQYLAATS

SEQ ID NO: 1391914 - protein, 9 aa, Homo Sapiens
MMYITSKPI

SEQ ID NO: 1391915 - protein, 9 aa, Homo Sapiens
PGGLRHALS

SEQ ID NO: 1391916 - protein, 9 aa, Homo Sapiens
KSDELIGQK

SEQ ID NO: 1391917 - protein, 9 aa, Homo Sapiens
KCITAHEAL

SEQ ID NO: 1391918 - protein, 9 aa, Homo Sapiens
YTLEDQDWE

SEQ ID NO: 1391919 - protein, 9 aa, Homo Sapiens
IAVLYLKKK

SEQ ID NO: 1391920 - protein, 9 aa, Homo Sapiens
IYDAWFPDQ

SEQ ID NO: 1391921 - protein, 9 aa, Homo Sapiens
CTSAVSAPQ

SEQ ID NO: 1391922 - protein, 9 aa, Homo Sapiens
KVLMRVLDA

SEQ ID NO: 1391923 - protein, 9 aa, Homo Sapiens
MENCFYLHI

SEQ ID NO: 1391924 - protein, 9 aa, Homo Sapiens
FSSCTLDQI

SEQ ID NO: 1391925 - protein, 9 aa, Homo Sapiens
WTQRGEEEA

SEQ ID NO: 1391926 - protein, 9 aa, Homo Sapiens
GQACQDQWF

SEQ ID NO: 1391927 - protein, 9 aa, Homo Sapiens
VIIYIFPAV

SEQ ID NO: 1391928 - protein, 9 aa, Homo Sapiens
NMLEALSEG

SEQ ID NO: 1391929 - protein, 9 aa, Homo Sapiens
VCSHPRLDH

SEQ ID NO: 1391930 - protein, 9 aa, Homo Sapiens
LTQARPRNA

SEQ ID NO: 1391931 - protein, 9 aa, Homo Sapiens
SGTHSPADD

SEQ ID NO: 1391932 - protein, 9 aa, Homo Sapiens
SDVEYAKEK

SEQ ID NO: 1391933 - protein, 9 aa, Homo Sapiens
THPRKVAGG

SEQ ID NO: 1391934 - protein, 9 aa, Homo Sapiens
SGSRKCKHR

SEQ ID NO: 1391935 - protein, 9 aa, Homo Sapiens
YECKDRGKA

SEQ ID NO: 1391936 - protein, 9 aa, Homo Sapiens
FRVEFSGES

SEQ ID NO: 1391937 - protein, 9 aa, Homo Sapiens
QELQVLVMV

SEQ ID NO: 1391938 - protein, 9 aa, Homo Sapiens
EFRDLLKVG

SEQ ID NO: 1391939 - protein, 9 aa, Homo Sapiens
KDQDKEKEK

SEQ ID NO: 1391940 - protein, 9 aa, Homo Sapiens
GSKPLCVKK

SEQ ID NO: 1391941 - protein, 9 aa, Homo Sapiens
TSQEILLLA

SEQ ID NO: 1391942 - protein, 9 aa, Homo Sapiens
LITIWVYVY

SEQ ID NO: 1391943 - protein, 9 aa, Homo Sapiens
FSSCRRDDS

SEQ ID NO: 1391944 - protein, 9 aa, Homo Sapiens
GTDFPSCVN

SEQ ID NO: 1391945 - protein, 9 aa, Homo Sapiens
TQLVLSGEG

SEQ ID NO: 1391946 - protein, 9 aa, Homo Sapiens
FQKSSTSPK

SEQ ID NO: 1391947 - protein, 9 aa, Homo Sapiens
DMSVLQRVL

SEQ ID NO: 1391948 - protein, 9 aa, Homo Sapiens
DPRQPSYNI

SEQ ID NO: 1391949 - protein, 9 aa, Homo Sapiens
SLLSPCNAS

SEQ ID NO: 1391950 - protein, 9 aa, Homo Sapiens
VVPPSTQVE

SEQ ID NO: 1391951 - protein, 9 aa, Homo Sapiens
KELGKGAFS

SEQ ID NO: 1391952 - protein, 9 aa, Homo Sapiens
PFLRGLWCS

SEQ ID NO: 1391953 - protein, 9 aa, Homo Sapiens
IMSHYRHLL

SEQ ID NO: 1391954 - protein, 9 aa, Homo Sapiens
FPANGKMHG

SEQ ID NO: 1391955 - protein, 9 aa, Homo Sapiens
SWQVSLRLN

SEQ ID NO: 1391956 - protein, 9 aa, Homo Sapiens
DAQVFIQKN

SEQ ID NO: 1391957 - protein, 9 aa, Homo Sapiens
QEALHEHSN

SEQ ID NO: 1391958 - protein, 9 aa, Homo Sapiens
PSWAWRSRA

SEQ ID NO: 1391959 - protein, 9 aa, Homo Sapiens
PFHVLALEV

SEQ ID NO: 1391960 - protein, 9 aa, Homo Sapiens
VHEALQLCR

SEQ ID NO: 1391961 - protein, 9 aa, Homo Sapiens
ASLIDGVGI

SEQ ID NO: 1391962 - protein, 9 aa, Homo Sapiens
PPSPARAAA

SEQ ID NO: 1391963 - protein, 9 aa, Homo Sapiens
VLRRCLCAD

SEQ ID NO: 1391964 - protein, 9 aa, Homo Sapiens
QQPPYFPLK

SEQ ID NO: 1391965 - protein, 9 aa, Homo Sapiens
RKNNFRLRG

SEQ ID NO: 1391966 - protein, 9 aa, Homo Sapiens
IRCCQQKEK

SEQ ID NO: 1391967 - protein, 9 aa, Homo Sapiens
GPGPSEGVI

SEQ ID NO: 1391968 - protein, 9 aa, Homo Sapiens
ECLEEFEGG

SEQ ID NO: 1391969 - protein, 9 aa, Homo Sapiens
TRRYGELTK

SEQ ID NO: 1391970 - protein, 9 aa, Homo Sapiens
SQVNRIDET

SEQ ID NO: 1391971 - protein, 9 aa, Homo Sapiens
SPPCTSAVS

SEQ ID NO: 1391972 - protein, 9 aa, Homo Sapiens
ENTVDTATK

SEQ ID NO: 1391973 - protein, 9 aa, Homo Sapiens
AVVASSSGG

SEQ ID NO: 1391974 - protein, 9 aa, Homo Sapiens
LHQLIMNTS

SEQ ID NO: 1391975 - protein, 9 aa, Homo Sapiens
RIERLTIRK

SEQ ID NO: 1391976 - protein, 9 aa, Homo Sapiens
IFLMKRFLT

SEQ ID NO: 1391977 - protein, 9 aa, Homo Sapiens
LRVLDRQGW

SEQ ID NO: 1391978 - protein, 9 aa, Homo Sapiens
SFTKQNKLV

SEQ ID NO: 1391979 - protein, 9 aa, Homo Sapiens
CKQCVKALS

SEQ ID NO: 1391980 - protein, 9 aa, Homo Sapiens
YVLFHPEAV

SEQ ID NO: 1391981 - protein, 9 aa, Homo Sapiens
EVAVGQVLK

SEQ ID NO: 1391982 - protein, 9 aa, Homo Sapiens
VCKVHITVL

SEQ ID NO: 1391983 - protein, 9 aa, Homo Sapiens
CMWLWMSSG

SEQ ID NO: 1391984 - protein, 9 aa, Homo Sapiens
LSPISACPR

SEQ ID NO: 1391985 - protein, 9 aa, Homo Sapiens
APPSLRAAR

SEQ ID NO: 1391986 - protein, 9 aa, Homo Sapiens
ALPGQPPSP

SEQ ID NO: 1391987 - protein, 9 aa, Homo Sapiens
VLSVLKHPL

SEQ ID NO: 1391988 - protein, 9 aa, Homo Sapiens
SVVLVCVPR

SEQ ID NO: 1391989 - protein, 9 aa, Homo Sapiens
KYPEAVCVV

SEQ ID NO: 1391990 - protein, 9 aa, Homo Sapiens
RCGCSPSMS

SEQ ID NO: 1391991 - protein, 9 aa, Homo Sapiens
KMLVNGKKG

SEQ ID NO: 1391992 - protein, 9 aa, Homo Sapiens
LQHAADLLR

SEQ ID NO: 1391993 - protein, 9 aa, Homo Sapiens
GSVSSTGRP

SEQ ID NO: 1391994 - protein, 9 aa, Homo Sapiens
GLEDRGLTS

SEQ ID NO: 1391995 - protein, 9 aa, Homo Sapiens
SETSYYKSL

SEQ ID NO: 1391996 - protein, 9 aa, Homo Sapiens
TVSFLKEHL

SEQ ID NO: 1391997 - protein, 9 aa, Homo Sapiens
VLKKQLFEK

SEQ ID NO: 1391998 - protein, 9 aa, Homo Sapiens
STPTQYIAV

SEQ ID NO: 1391999 - protein, 9 aa, Homo Sapiens
EEELKEARH

SEQ ID NO: 1392000 - protein, 9 aa, Homo Sapiens
VQDYEVMMQ

SEQ ID NO: 1392001 - protein, 9 aa, Homo Sapiens
VHITVLAVV

SEQ ID NO: 1392002 - protein, 9 aa, Homo Sapiens
MKFYIPHVH

SEQ ID NO: 1392003 - protein, 9 aa, Homo Sapiens
LDRLGEGTY

SEQ ID NO: 1392004 - protein, 9 aa, Homo Sapiens
ADRRGAESM

SEQ ID NO: 1392005 - protein, 9 aa, Homo Sapiens
ARPRNAGIY

SEQ ID NO: 1392006 - protein, 9 aa, Homo Sapiens
NLTTKKCLG

SEQ ID NO: 1392007 - protein, 9 aa, Homo Sapiens
LAVHRQKLL

SEQ ID NO: 1392008 - protein, 9 aa, Homo Sapiens
SEEIFGRIT

SEQ ID NO: 1392009 - protein, 9 aa, Homo Sapiens
FTDEENRDV

SEQ ID NO: 1392010 - protein, 9 aa, Homo Sapiens
MEEMKRRIS

SEQ ID NO: 1392011 - protein, 9 aa, Homo Sapiens
LRGGGGGQG

SEQ ID NO: 1392012 - protein, 9 aa, Homo Sapiens
GGVEAEAVM

SEQ ID NO: 1392013 - protein, 9 aa, Homo Sapiens
GKDVPEGLG

SEQ ID NO: 1392014 - protein, 9 aa, Homo Sapiens
VLDCANNVE

SEQ ID NO: 1392015 - protein, 9 aa, Homo Sapiens
VQEAFAQGM

SEQ ID NO: 1392016 - protein, 9 aa, Homo Sapiens
DVQQLVYEA

SEQ ID NO: 1392017 - protein, 9 aa, Homo Sapiens
SGSVSSTGR

SEQ ID NO: 1392018 - protein, 9 aa, Homo Sapiens
VIETTNVEK

SEQ ID NO: 1392019 - protein, 9 aa, Homo Sapiens
KYEHQKKLN

SEQ ID NO: 1392020 - protein, 9 aa, Homo Sapiens
TKLLKNILP

SEQ ID NO: 1392021 - protein, 9 aa, Homo Sapiens
CPLASQAIS

SEQ ID NO: 1392022 - protein, 9 aa, Homo Sapiens
NLQAALDDY

SEQ ID NO: 1392023 - protein, 9 aa, Homo Sapiens
QLIMNTSTE

SEQ ID NO: 1392024 - protein, 9 aa, Homo Sapiens
EEAREEPLE

SEQ ID NO: 1392025 - protein, 9 aa, Homo Sapiens
LPLQLLWLG

SEQ ID NO: 1392026 - protein, 9 aa, Homo Sapiens
EDSLCSSER

SEQ ID NO: 1392027 - protein, 9 aa, Homo Sapiens
RSPPELVVE

SEQ ID NO: 1392028 - protein, 9 aa, Homo Sapiens
VFPYRTAGV

SEQ ID NO: 1392029 - protein, 9 aa, Homo Sapiens
LTDSGNVQK

SEQ ID NO: 1392030 - protein, 9 aa, Homo Sapiens
PPLTNTSAT

SEQ ID NO: 1392031 - protein, 9 aa, Homo Sapiens
AHVHIRVLG

SEQ ID NO: 1392032 - protein, 9 aa, Homo Sapiens
SQCSSGSCP

SEQ ID NO: 1392033 - protein, 9 aa, Homo Sapiens
PWRGVGETP

SEQ ID NO: 1392034 - protein, 9 aa, Homo Sapiens
LSVAFSPSY

SEQ ID NO: 1392035 - protein, 9 aa, Homo Sapiens
PPAMKHYLL

SEQ ID NO: 1392036 - protein, 9 aa, Homo Sapiens
MLRYLETHP

SEQ ID NO: 1392037 - protein, 9 aa, Homo Sapiens
PSLSRSLQN

SEQ ID NO: 1392038 - protein, 9 aa, Homo Sapiens
ALAVHRQKL

SEQ ID NO: 1392039 - protein, 9 aa, Homo Sapiens
YIYLLVRHM

SEQ ID NO: 1392040 - protein, 9 aa, Homo Sapiens
DSVEHRDNL

SEQ ID NO: 1392041 - protein, 9 aa, Homo Sapiens
MLEELRNLR

SEQ ID NO: 1392042 - protein, 9 aa, Homo Sapiens
RSCALSYGR

SEQ ID NO: 1392043 - protein, 9 aa, Homo Sapiens
FTDFGTYIC

SEQ ID NO: 1392044 - protein, 9 aa, Homo Sapiens
CRTTEPVIP

SEQ ID NO: 1392045 - protein, 9 aa, Homo Sapiens
LERAYGRLW

SEQ ID NO: 1392046 - protein, 9 aa, Homo Sapiens
VLENLQKSA

SEQ ID NO: 1392047 - protein, 9 aa, Homo Sapiens
SLPQEQKQA

SEQ ID NO: 1392048 - protein, 9 aa, Homo Sapiens
AQGMRRNLR

SEQ ID NO: 1392049 - protein, 9 aa, Homo Sapiens
LGIFKVTRH

SEQ ID NO: 1392050 - protein, 9 aa, Homo Sapiens
YVNVNIRGI

SEQ ID NO: 1392051 - protein, 9 aa, Homo Sapiens
RKVAGGHSG

SEQ ID NO: 1392052 - protein, 9 aa, Homo Sapiens
FLRSVFETL

SEQ ID NO: 1392053 - protein, 9 aa, Homo Sapiens
DDDDDEKRG

SEQ ID NO: 1392054 - protein, 9 aa, Homo Sapiens
PLYYSTIMS

SEQ ID NO: 1392055 - protein, 9 aa, Homo Sapiens
NVAKDGRLA

SEQ ID NO: 1392056 - protein, 9 aa, Homo Sapiens
CKVLMRVLD

SEQ ID NO: 1392057 - protein, 9 aa, Homo Sapiens
SLHKTRPLV

SEQ ID NO: 1392058 - protein, 9 aa, Homo Sapiens
VSVVTPAQD

SEQ ID NO: 1392059 - protein, 9 aa, Homo Sapiens
PQRKGVCVA

SEQ ID NO: 1392060 - protein, 9 aa, Homo Sapiens
CGKAYISCS

SEQ ID NO: 1392061 - protein, 9 aa, Homo Sapiens
CDGRLYASE

SEQ ID NO: 1392062 - protein, 9 aa, Homo Sapiens
QPLHAVHHC

SEQ ID NO: 1392063 - protein, 9 aa, Homo Sapiens
WPWTRCLRM

SEQ ID NO: 1392064 - protein, 9 aa, Homo Sapiens
HVLSCMGGG

SEQ ID NO: 1392065 - protein, 9 aa, Homo Sapiens
ETPGAVHLA

SEQ ID NO: 1392066 - protein, 9 aa, Homo Sapiens
IGCWEKLFS

SEQ ID NO: 1392067 - protein, 9 aa, Homo Sapiens
CSHRGLSSP

SEQ ID NO: 1392068 - protein, 9 aa, Homo Sapiens
LLILLGICT

SEQ ID NO: 1392069 - protein, 9 aa, Homo Sapiens
PLYFAVDPG

SEQ ID NO: 1392070 - protein, 9 aa, Homo Sapiens
AAPSSDPPP

SEQ ID NO: 1392071 - protein, 9 aa, Homo Sapiens
LVLVFMKME

SEQ ID NO: 1392072 - protein, 9 aa, Homo Sapiens
LSSQKSVPC

SEQ ID NO: 1392073 - protein, 9 aa, Homo Sapiens
AAQLSEDVQ

SEQ ID NO: 1392074 - protein, 9 aa, Homo Sapiens
RGLRLIIPV

SEQ ID NO: 1392075 - protein, 9 aa, Homo Sapiens
VLDVSSISH

SEQ ID NO: 1392076 - protein, 9 aa, Homo Sapiens
ANGKMHGTV

SEQ ID NO: 1392077 - protein, 9 aa, Homo Sapiens
PCIGEESGG

SEQ ID NO: 1392078 - protein, 9 aa, Homo Sapiens
CHFHVTVFK

SEQ ID NO: 1392079 - protein, 9 aa, Homo Sapiens
KGNTALHIT

SEQ ID NO: 1392080 - protein, 9 aa, Homo Sapiens
QNPSNRSLP

SEQ ID NO: 1392081 - protein, 9 aa, Homo Sapiens
FTHSFLLTI

SEQ ID NO: 1392082 - protein, 9 aa, Homo Sapiens
EDFHLQNST

SEQ ID NO: 1392083 - protein, 9 aa, Homo Sapiens
REEPLESSK

SEQ ID NO: 1392084 - protein, 9 aa, Homo Sapiens
IDFRTQEST

SEQ ID NO: 1392085 - protein, 9 aa, Homo Sapiens
PPEPGDPDA

SEQ ID NO: 1392086 - protein, 9 aa, Homo Sapiens
LLKHLQPEF

SEQ ID NO: 1392087 - protein, 9 aa, Homo Sapiens
LRKIQENYG

SEQ ID NO: 1392088 - protein, 9 aa, Homo Sapiens
FKQAKRGSS

SEQ ID NO: 1392089 - protein, 9 aa, Homo Sapiens
SQCTQGRRW

SEQ ID NO: 1392090 - protein, 9 aa, Homo Sapiens
QMVPYGLSN

SEQ ID NO: 1392091 - protein, 9 aa, Homo Sapiens
VFPMQDSGG

SEQ ID NO: 1392092 - protein, 9 aa, Homo Sapiens
KNRSLILKR

SEQ ID NO: 1392093 - protein, 9 aa, Homo Sapiens
HTSPEEEPI

SEQ ID NO: 1392094 - protein, 9 aa, Homo Sapiens
ADLVIFHFP

SEQ ID NO: 1392095 - protein, 9 aa, Homo Sapiens
DIEVQIGGN

SEQ ID NO: 1392096 - protein, 9 aa, Homo Sapiens
RLYMQFQEP

SEQ ID NO: 1392097 - protein, 9 aa, Homo Sapiens
DLFCSLKQV

SEQ ID NO: 1392098 - protein, 9 aa, Homo Sapiens
KENRRPPSG

SEQ ID NO: 1392099 - protein, 9 aa, Homo Sapiens
YREIDKRMD

SEQ ID NO: 1392100 - protein, 9 aa, Homo Sapiens
NLYLLILRF

SEQ ID NO: 1392101 - protein, 9 aa, Homo Sapiens
LLGMCLTSS

SEQ ID NO: 1392102 - protein, 9 aa, Homo Sapiens
GMQGARGLP

SEQ ID NO: 1392103 - protein, 9 aa, Homo Sapiens
LLGLFFLDK

SEQ ID NO: 1392104 - protein, 9 aa, Homo Sapiens
AICKAGGIP

SEQ ID NO: 1392105 - protein, 9 aa, Homo Sapiens
KDPNYWIQA

SEQ ID NO: 1392106 - protein, 9 aa, Homo Sapiens
HSTASGQGK

SEQ ID NO: 1392107 - protein, 9 aa, Homo Sapiens
GSQQYKLGV

SEQ ID NO: 1392108 - protein, 9 aa, Homo Sapiens
GRCGCSPSM

SEQ ID NO: 1392109 - protein, 9 aa, Homo Sapiens
WDLPRRRLC

SEQ ID NO: 1392110 - protein, 9 aa, Homo Sapiens
VAVDGTFIL

SEQ ID NO: 1392111 - protein, 9 aa, Homo Sapiens
AGAQPASST

SEQ ID NO: 1392112 - protein, 9 aa, Homo Sapiens
IDINDHYPM

SEQ ID NO: 1392113 - protein, 9 aa, Homo Sapiens
FFNSPKSLF

SEQ ID NO: 1392114 - protein, 9 aa, Homo Sapiens
QDWEFMVFA

SEQ ID NO: 1392115 - protein, 9 aa, Homo Sapiens
VILWDLLRF

SEQ ID NO: 1392116 - protein, 9 aa, Homo Sapiens
VVCKVHITV

SEQ ID NO: 1392117 - protein, 9 aa, Homo Sapiens
GPKCNRAIC

SEQ ID NO: 1392118 - protein, 9 aa, Homo Sapiens
MSVRIVKNW

SEQ ID NO: 1392119 - protein, 9 aa, Homo Sapiens
KNIPGIRGA

SEQ ID NO: 1392120 - protein, 9 aa, Homo Sapiens
SGMEMEEMK

SEQ ID NO: 1392121 - protein, 9 aa, Homo Sapiens
RSHGRERRG

SEQ ID NO: 1392122 - protein, 9 aa, Homo Sapiens
QNQRGLASV

SEQ ID NO: 1392123 - protein, 9 aa, Homo Sapiens
YSCNVFLGG

SEQ ID NO: 1392124 - protein, 9 aa, Homo Sapiens
MCEHSNTLI

SEQ ID NO: 1392125 - protein, 9 aa, Homo Sapiens
DRQSFGPVM

SEQ ID NO: 1392126 - protein, 9 aa, Homo Sapiens
ADGLLCSSK

SEQ ID NO: 1392127 - protein, 9 aa, Homo Sapiens
GAPPECCSS

SEQ ID NO: 1392128 - protein, 9 aa, Homo Sapiens
TSETSYYKS

SEQ ID NO: 1392129 - protein, 9 aa, Homo Sapiens
SLCSSERAG

SEQ ID NO: 1392130 - protein, 9 aa, Homo Sapiens
AEHFSPFRI

SEQ ID NO: 1392131 - protein, 9 aa, Homo Sapiens
ENRSFEGIL

SEQ ID NO: 1392132 - protein, 9 aa, Homo Sapiens
AQKLTFRVA

SEQ ID NO: 1392133 - protein, 9 aa, Homo Sapiens
VMVYQTKSP

SEQ ID NO: 1392134 - protein, 9 aa, Homo Sapiens
QGNTVQLHG

SEQ ID NO: 1392135 - protein, 9 aa, Homo Sapiens
MVLLKTNWK

SEQ ID NO: 1392136 - protein, 9 aa, Homo Sapiens
PGPNEAPPP

SEQ ID NO: 1392137 - protein, 9 aa, Homo Sapiens
PISDNSSRQ

SEQ ID NO: 1392138 - protein, 9 aa, Homo Sapiens
IRGIDKIYV

SEQ ID NO: 1392139 - protein, 9 aa, Homo Sapiens
TPPASPWLP

SEQ ID NO: 1392140 - protein, 9 aa, Homo Sapiens
SLLLTQARP

SEQ ID NO: 1392141 - protein, 9 aa, Homo Sapiens
GKRGAEDPC

SEQ ID NO: 1392142 - protein, 9 aa, Homo Sapiens
HSRRMSVRI

SEQ ID NO: 1392143 - protein, 9 aa, Homo Sapiens
ETGAPLPER

SEQ ID NO: 1392144 - protein, 9 aa, Homo Sapiens
VADEYLNKV

SEQ ID NO: 1392145 - protein, 9 aa, Homo Sapiens
VKEQKGKRP

SEQ ID NO: 1392146 - protein, 9 aa, Homo Sapiens
PSSPAAACA

SEQ ID NO: 1392147 - protein, 9 aa, Homo Sapiens
PEAWLWYHQ

SEQ ID NO: 1392148 - protein, 9 aa, Homo Sapiens
SSAVVKGMN

SEQ ID NO: 1392149 - protein, 9 aa, Homo Sapiens
LKELRESIK

SEQ ID NO: 1392150 - protein, 9 aa, Homo Sapiens
GGLSDRPSV

SEQ ID NO: 1392151 - protein, 9 aa, Homo Sapiens
QAKREEECS

SEQ ID NO: 1392152 - protein, 9 aa, Homo Sapiens
WGKFLVSIT

SEQ ID NO: 1392153 - protein, 9 aa, Homo Sapiens
LCVDMNATT

SEQ ID NO: 1392154 - protein, 9 aa, Homo Sapiens
LILVVCREN

SEQ ID NO: 1392155 - protein, 9 aa, Homo Sapiens
SYNIKSVCS

SEQ ID NO: 1392156 - protein, 9 aa, Homo Sapiens
APTKSGTHS

SEQ ID NO: 1392157 - protein, 9 aa, Homo Sapiens
ECTGKHPRR

SEQ ID NO: 1392158 - protein, 9 aa, Homo Sapiens
RGAEDPCFI

SEQ ID NO: 1392159 - protein, 9 aa, Homo Sapiens
TSSCCSWSC

SEQ ID NO: 1392160 - protein, 9 aa, Homo Sapiens
PACSHKVLA

SEQ ID NO: 1392161 - protein, 9 aa, Homo Sapiens
IAMDATLRK

SEQ ID NO: 1392162 - protein, 9 aa, Homo Sapiens
LSLQTEGGF

SEQ ID NO: 1392163 - protein, 9 aa, Homo Sapiens
LFEKNRSLI

SEQ ID NO: 1392164 - protein, 9 aa, Homo Sapiens
VRFDLLGQP

SEQ ID NO: 1392165 - protein, 9 aa, Homo Sapiens
DGVNPAVRS

SEQ ID NO: 1392166 - protein, 9 aa, Homo Sapiens
LSSFLIFFI

SEQ ID NO: 1392167 - protein, 9 aa, Homo Sapiens
PWKNPALWD

SEQ ID NO: 1392168 - protein, 9 aa, Homo Sapiens
WGGRHHHHP

SEQ ID NO: 1392169 - protein, 9 aa, Homo Sapiens
KMCPLWRST

SEQ ID NO: 1392170 - protein, 9 aa, Homo Sapiens
TDMIKMLVN

SEQ ID NO: 1392171 - protein, 9 aa, Homo Sapiens
CEDEHFELD

SEQ ID NO: 1392172 - protein, 9 aa, Homo Sapiens
KSISLYWGN

SEQ ID NO: 1392173 - protein, 9 aa, Homo Sapiens
HIFSTVLRI

SEQ ID NO: 1392174 - protein, 9 aa, Homo Sapiens
EDPYWKEDL

SEQ ID NO: 1392175 - protein, 9 aa, Homo Sapiens
SDVGLLEGS

SEQ ID NO: 1392176 - protein, 9 aa, Homo Sapiens
KIGVAIQEE

SEQ ID NO: 1392177 - protein, 9 aa, Homo Sapiens
EPAVAAPSS

SEQ ID NO: 1392178 - protein, 9 aa, Homo Sapiens
AETQDVQMK

SEQ ID NO: 1392179 - protein, 9 aa, Homo Sapiens
NNIVVHPSR

SEQ ID NO: 1392180 - protein, 9 aa, Homo Sapiens
YSMAHSATH

SEQ ID NO: 1392181 - protein, 9 aa, Homo Sapiens
MGVVPPSTQ

SEQ ID NO: 1392182 - protein, 9 aa, Homo Sapiens
PPTVSQARL

SEQ ID NO: 1392183 - protein, 9 aa, Homo Sapiens
SRYNDGRCL

SEQ ID NO: 1392184 - protein, 9 aa, Homo Sapiens
SSSTHLPPS

SEQ ID NO: 1392185 - protein, 9 aa, Homo Sapiens
KRPVNAFMV

SEQ ID NO: 1392186 - protein, 9 aa, Homo Sapiens
RGLKMKCVG

SEQ ID NO: 1392187 - protein, 9 aa, Homo Sapiens
SMTLLFEVF

SEQ ID NO: 1392188 - protein, 9 aa, Homo Sapiens
SKEPNLVLD

SEQ ID NO: 1392189 - protein, 9 aa, Homo Sapiens
RGGGCLPPE

SEQ ID NO: 1392190 - protein, 9 aa, Homo Sapiens
DCLPTDVEC

SEQ ID NO: 1392191 - protein, 9 aa, Homo Sapiens
WFPDQGRYE

SEQ ID NO: 1392192 - protein, 9 aa, Homo Sapiens
SSYRSSQCS

SEQ ID NO: 1392193 - protein, 9 aa, Homo Sapiens
RVLEVKKPP

SEQ ID NO: 1392194 - protein, 9 aa, Homo Sapiens
SLILKRKGL

SEQ ID NO: 1392195 - protein, 9 aa, Homo Sapiens
MLPVRSQTN

SEQ ID NO: 1392196 - protein, 9 aa, Homo Sapiens
TKPGLQERL

SEQ ID NO: 1392197 - protein, 9 aa, Homo Sapiens
LSSPTTHRD

SEQ ID NO: 1392198 - protein, 9 aa, Homo Sapiens
RVTRILPCL

SEQ ID NO: 1392199 - protein, 9 aa, Homo Sapiens
PPGGCHPAW

SEQ ID NO: 1392200 - protein, 9 aa, Homo Sapiens
EEEGKRKEW

SEQ ID NO: 1392201 - protein, 9 aa, Homo Sapiens
STGRPASAS

SEQ ID NO: 1392202 - protein, 9 aa, Homo Sapiens
KQPDLRGRG

SEQ ID NO: 1392203 - protein, 9 aa, Homo Sapiens
VLFHPEAVH

SEQ ID NO: 1392204 - protein, 9 aa, Homo Sapiens
GFQWGESPW

SEQ ID NO: 1392205 - protein, 9 aa, Homo Sapiens
ADMMVDFRV

SEQ ID NO: 1392206 - protein, 9 aa, Homo Sapiens
PSSSDTFFN

SEQ ID NO: 1392207 - protein, 9 aa, Homo Sapiens
IANNLCLDE

SEQ ID NO: 1392208 - protein, 9 aa, Homo Sapiens
ESLRMRYVL

SEQ ID NO: 1392209 - protein, 9 aa, Homo Sapiens
LSWRWGTLR

SEQ ID NO: 1392210 - protein, 9 aa, Homo Sapiens
CVMLDLAGS

SEQ ID NO: 1392211 - protein, 9 aa, Homo Sapiens
TSASGAFVP

SEQ ID NO: 1392212 - protein, 9 aa, Homo Sapiens
EELNMETLV

SEQ ID NO: 1392213 - protein, 9 aa, Homo Sapiens
VQLHGMRKG

SEQ ID NO: 1392214 - protein, 9 aa, Homo Sapiens
IQENYGDVY

SEQ ID NO: 1392215 - protein, 9 aa, Homo Sapiens
AHKLWMIVI

SEQ ID NO: 1392216 - protein, 9 aa, Homo Sapiens
SQAISARSW

SEQ ID NO: 1392217 - protein, 9 aa, Homo Sapiens
NNMMNKMRD

SEQ ID NO: 1392218 - protein, 9 aa, Homo Sapiens
SMLVMLPSC

SEQ ID NO: 1392219 - protein, 9 aa, Homo Sapiens
RKCPKHVNL

SEQ ID NO: 1392220 - protein, 9 aa, Homo Sapiens
VLVAMAFDC

SEQ ID NO: 1392221 - protein, 9 aa, Homo Sapiens
LCSTSLGWC

SEQ ID NO: 1392222 - protein, 9 aa, Homo Sapiens
TQANGFMKK

SEQ ID NO: 1392223 - protein, 9 aa, Homo Sapiens
GVPGSPGMQ

SEQ ID NO: 1392224 - protein, 9 aa, Homo Sapiens
LRRAALKSA

SEQ ID NO: 1392225 - protein, 9 aa, Homo Sapiens
AHCFAPRGL

SEQ ID NO: 1392226 - protein, 9 aa, Homo Sapiens
EVMKTRTCS

SEQ ID NO: 1392227 - protein, 9 aa, Homo Sapiens
GMPASKKCR

SEQ ID NO: 1392228 - protein, 9 aa, Homo Sapiens
FPSCVNCVQ

SEQ ID NO: 1392229 - protein, 9 aa, Homo Sapiens
ALCSARALP

SEQ ID NO: 1392230 - protein, 9 aa, Homo Sapiens
QTQANGFMK

SEQ ID NO: 1392231 - protein, 9 aa, Homo Sapiens
APVSGGQFR

SEQ ID NO: 1392232 - protein, 9 aa, Homo Sapiens
ELLQKTIRN

SEQ ID NO: 1392233 - protein, 9 aa, Homo Sapiens
CSYLSLKDS

SEQ ID NO: 1392234 - protein, 9 aa, Homo Sapiens
LQRNLLRLQ

SEQ ID NO: 1392235 - protein, 9 aa, Homo Sapiens
MLTINPAKC

SEQ ID NO: 1392236 - protein, 9 aa, Homo Sapiens
LDAANLEKI

SEQ ID NO: 1392237 - protein, 9 aa, Homo Sapiens
IDRMLQEAE

SEQ ID NO: 1392238 - protein, 9 aa, Homo Sapiens
QFRAGPTPS

SEQ ID NO: 1392239 - protein, 9 aa, Homo Sapiens
TPQPSLPGP

SEQ ID NO: 1392240 - protein, 9 aa, Homo Sapiens
YEAELGDAS

SEQ ID NO: 1392241 - protein, 9 aa, Homo Sapiens
CGNRRGSVL

SEQ ID NO: 1392242 - protein, 9 aa, Homo Sapiens
PLHHPERIH

SEQ ID NO: 1392243 - protein, 9 aa, Homo Sapiens
ASLWGWSLW

SEQ ID NO: 1392244 - protein, 9 aa, Homo Sapiens
ILQHAADLL

SEQ ID NO: 1392245 - protein, 9 aa, Homo Sapiens
RDLLKVGTA

SEQ ID NO: 1392246 - protein, 9 aa, Homo Sapiens
QQQQGPPPQ

SEQ ID NO: 1392247 - protein, 9 aa, Homo Sapiens
RAGDIQTTR

SEQ ID NO: 1392248 - protein, 9 aa, Homo Sapiens
ILSPKSQTL

SEQ ID NO: 1392249 - protein, 9 aa, Homo Sapiens
QVETTFCAT

SEQ ID NO: 1392250 - protein, 9 aa, Homo Sapiens
GPGPCIGEE

SEQ ID NO: 1392251 - protein, 9 aa, Homo Sapiens
YRLLLKHLQ

SEQ ID NO: 1392252 - protein, 9 aa, Homo Sapiens
NPKILMTGK

SEQ ID NO: 1392253 - protein, 9 aa, Homo Sapiens
CWSPWASSA

SEQ ID NO: 1392254 - protein, 9 aa, Homo Sapiens
ANGAPPECC

SEQ ID NO: 1392255 - protein, 9 aa, Homo Sapiens
DYTKKPLYE

SEQ ID NO: 1392256 - protein, 9 aa, Homo Sapiens
SDLFCSLKQ

SEQ ID NO: 1392257 - protein, 9 aa, Homo Sapiens
ASLLTLMDD

SEQ ID NO: 1392258 - protein, 9 aa, Homo Sapiens
APQTAVLRL

SEQ ID NO: 1392259 - protein, 9 aa, Homo Sapiens
DRHWSMQNF

SEQ ID NO: 1392260 - protein, 9 aa, Homo Sapiens
VTPRESMTL

SEQ ID NO: 1392261 - protein, 9 aa, Homo Sapiens
PWYRGPTPS

SEQ ID NO: 1392262 - protein, 9 aa, Homo Sapiens
CLTGTHPRK

SEQ ID NO: 1392263 - protein, 9 aa, Homo Sapiens
FHCLNETQD

SEQ ID NO: 1392264 - protein, 9 aa, Homo Sapiens
KITSVVLVC

SEQ ID NO: 1392265 - protein, 9 aa, Homo Sapiens
LLAGSVGAG

SEQ ID NO: 1392266 - protein, 9 aa, Homo Sapiens
MLDDEEEGG

SEQ ID NO: 1392267 - protein, 9 aa, Homo Sapiens
VCGVWYMPP

SEQ ID NO: 1392268 - protein, 9 aa, Homo Sapiens
ILTKQIKTK

SEQ ID NO: 1392269 - protein, 9 aa, Homo Sapiens
NEVYKRAKV

SEQ ID NO: 1392270 - protein, 9 aa, Homo Sapiens
NKITDEAFY

SEQ ID NO: 1392271 - protein, 9 aa, Homo Sapiens
NTLIQQAMM

SEQ ID NO: 1392272 - protein, 9 aa, Homo Sapiens
GSQDVGIWY

SEQ ID NO: 1392273 - protein, 9 aa, Homo Sapiens
NKMRDNKYR

SEQ ID NO: 1392274 - protein, 9 aa, Homo Sapiens
LLAAQTRWW

SEQ ID NO: 1392275 - protein, 9 aa, Homo Sapiens
LWCSAEPPY

SEQ ID NO: 1392276 - protein, 9 aa, Homo Sapiens
MLSGKINTE

SEQ ID NO: 1392277 - protein, 9 aa, Homo Sapiens
ENAVSLTCH

SEQ ID NO: 1392278 - protein, 9 aa, Homo Sapiens
PPVAEEAAA

SEQ ID NO: 1392279 - protein, 9 aa, Homo Sapiens
PPPTKKRGK

SEQ ID NO: 1392280 - protein, 9 aa, Homo Sapiens
RHPQTAMCD

SEQ ID NO: 1392281 - protein, 9 aa, Homo Sapiens
TTTSCMWLW

SEQ ID NO: 1392282 - protein, 9 aa, Homo Sapiens
FSFPWGTLS

SEQ ID NO: 1392283 - protein, 9 aa, Homo Sapiens
VDTINHPAQ

SEQ ID NO: 1392284 - protein, 9 aa, Homo Sapiens
ISVVGMSPT

SEQ ID NO: 1392285 - protein, 9 aa, Homo Sapiens
AQVHQLLLS

SEQ ID NO: 1392286 - protein, 9 aa, Homo Sapiens
FLKHKLNSM

SEQ ID NO: 1392287 - protein, 9 aa, Homo Sapiens
PPWTLRMQR

SEQ ID NO: 1392288 - protein, 9 aa, Homo Sapiens
SYKEDMKEL

SEQ ID NO: 1392289 - protein, 9 aa, Homo Sapiens
GTHPRKVAG

SEQ ID NO: 1392290 - protein, 9 aa, Homo Sapiens
PEVGLVHEA

SEQ ID NO: 1392291 - protein, 9 aa, Homo Sapiens
PKSQTLDAE

SEQ ID NO: 1392292 - protein, 9 aa, Homo Sapiens
EIGSQQYKL

SEQ ID NO: 1392293 - protein, 9 aa, Homo Sapiens
EVIRNVAKD

SEQ ID NO: 1392294 - protein, 9 aa, Homo Sapiens
KTMDPGPGA

SEQ ID NO: 1392295 - protein, 9 aa, Homo Sapiens
RAISAYVRV

SEQ ID NO: 1392296 - protein, 9 aa, Homo Sapiens
SPWASSAPS

SEQ ID NO: 1392297 - protein, 9 aa, Homo Sapiens
LIGSGGSPW

SEQ ID NO: 1392298 - protein, 9 aa, Homo Sapiens
ISSLNRMPS

SEQ ID NO: 1392299 - protein, 9 aa, Homo Sapiens
CFVAQLVVR

SEQ ID NO: 1392300 - protein, 9 aa, Homo Sapiens
EDSTSKGDE

SEQ ID NO: 1392301 - protein, 9 aa, Homo Sapiens
PLLSILQHA

SEQ ID NO: 1392302 - protein, 9 aa, Homo Sapiens
AHLPLPSEF

SEQ ID NO: 1392303 - protein, 9 aa, Homo Sapiens
PWQVMASLT

SEQ ID NO: 1392304 - protein, 9 aa, Homo Sapiens
SPAAACAPG

SEQ ID NO: 1392305 - protein, 9 aa, Homo Sapiens
APSTRAAPP

SEQ ID NO: 1392306 - protein, 9 aa, Homo Sapiens
VPQETRSSS

SEQ ID NO: 1392307 - protein, 9 aa, Homo Sapiens
TSPKAQPTL

SEQ ID NO: 1392308 - protein, 9 aa, Homo Sapiens
SLLSLYSVA

SEQ ID NO: 1392309 - protein, 9 aa, Homo Sapiens
VGETPGAVH

SEQ ID NO: 1392310 - protein, 9 aa, Homo Sapiens
DVFNFETFG

SEQ ID NO: 1392311 - protein, 9 aa, Homo Sapiens
ADGTDFPSC

SEQ ID NO: 1392312 - protein, 9 aa, Homo Sapiens
RLGEGTYAT

SEQ ID NO: 1392313 - protein, 9 aa, Homo Sapiens
RMPSVTEAS

SEQ ID NO: 1392314 - protein, 9 aa, Homo Sapiens
DDEKRGSRS

SEQ ID NO: 1392315 - protein, 9 aa, Homo Sapiens
PGLLVIATG

SEQ ID NO: 1392316 - protein, 9 aa, Homo Sapiens
DLKKEWLIL

SEQ ID NO: 1392317 - protein, 9 aa, Homo Sapiens
SDSETSSTG

SEQ ID NO: 1392318 - protein, 9 aa, Homo Sapiens
KRRNNMMNK

SEQ ID NO: 1392319 - protein, 9 aa, Homo Sapiens
QSQQSLSLQ

SEQ ID NO: 1392320 - protein, 9 aa, Homo Sapiens
FGPVMVYQT

SEQ ID NO: 1392321 - protein, 9 aa, Homo Sapiens
HHVAADMMV

SEQ ID NO: 1392322 - protein, 9 aa, Homo Sapiens
GWPRFWACG

SEQ ID NO: 1392323 - protein, 9 aa, Homo Sapiens
REVATQMQS

SEQ ID NO: 1392324 - protein, 9 aa, Homo Sapiens
GSLAAEFQH

SEQ ID NO: 1392325 - protein, 9 aa, Homo Sapiens
GKELNSVAS

SEQ ID NO: 1392326 - protein, 9 aa, Homo Sapiens
FHLQNSTLM

SEQ ID NO: 1392327 - protein, 9 aa, Homo Sapiens
DDESFNPSL

SEQ ID NO: 1392328 - protein, 9 aa, Homo Sapiens
TWDQDGKGP

SEQ ID NO: 1392329 - protein, 9 aa, Homo Sapiens
SSSTSRDSR

SEQ ID NO: 1392330 - protein, 9 aa, Homo Sapiens
WTGHTSDAG

SEQ ID NO: 1392331 - protein, 9 aa, Homo Sapiens
PPCTSAVSA

SEQ ID NO: 1392332 - protein, 9 aa, Homo Sapiens
FAPFFVPMS

SEQ ID NO: 1392333 - protein, 9 aa, Homo Sapiens
EYAEEEKKE

SEQ ID NO: 1392334 - protein, 9 aa, Homo Sapiens
TAPRGPAAP

SEQ ID NO: 1392335 - protein, 9 aa, Homo Sapiens
CSARALPRR

SEQ ID NO: 1392336 - protein, 9 aa, Homo Sapiens
QDKHLVDEL

SEQ ID NO: 1392337 - protein, 9 aa, Homo Sapiens
TKPQKNVKV

SEQ ID NO: 1392338 - protein, 9 aa, Homo Sapiens
KQAKACPIS

SEQ ID NO: 1392339 - protein, 9 aa, Homo Sapiens
LRLLIPECF

SEQ ID NO: 1392340 - protein, 9 aa, Homo Sapiens
KRKEKTAKM

SEQ ID NO: 1392341 - protein, 9 aa, Homo Sapiens
YRTAHAMRE

SEQ ID NO: 1392342 - protein, 9 aa, Homo Sapiens
GHEAETLAL

SEQ ID NO: 1392343 - protein, 9 aa, Homo Sapiens
FQMIRTLNA

SEQ ID NO: 1392344 - protein, 9 aa, Homo Sapiens
YPIQVLTYE

SEQ ID NO: 1392345 - protein, 9 aa, Homo Sapiens
NLSSSSTIL

SEQ ID NO: 1392346 - protein, 9 aa, Homo Sapiens
TYFYTRFAA

SEQ ID NO: 1392347 - protein, 9 aa, Homo Sapiens
FNLNGNSVT

SEQ ID NO: 1392348 - protein, 9 aa, Homo Sapiens
SAPRHHPRS

SEQ ID NO: 1392349 - protein, 9 aa, Homo Sapiens
QPACGALWD

SEQ ID NO: 1392350 - protein, 9 aa, Homo Sapiens
LLVALSLDR

SEQ ID NO: 1392351 - protein, 9 aa, Homo Sapiens
EDCCLRLKV

SEQ ID NO: 1392352 - protein, 9 aa, Homo Sapiens
SPQWATINT

SEQ ID NO: 1392353 - protein, 9 aa, Homo Sapiens
FSIKRGPSQ

SEQ ID NO: 1392354 - protein, 9 aa, Homo Sapiens
WLLRYPSLL

SEQ ID NO: 1392355 - protein, 9 aa, Homo Sapiens
QPSFAPESS

SEQ ID NO: 1392356 - protein, 9 aa, Homo Sapiens
RYKIDSLIG

SEQ ID NO: 1392357 - protein, 9 aa, Homo Sapiens
SLNRYIEKS

SEQ ID NO: 1392358 - protein, 9 aa, Homo Sapiens
PIPTGSRRN

SEQ ID NO: 1392359 - protein, 9 aa, Homo Sapiens
RHPHRSPPT

SEQ ID NO: 1392360 - protein, 9 aa, Homo Sapiens
LLYEEAHYY

SEQ ID NO: 1392361 - protein, 9 aa, Homo Sapiens
SVCSQGSLF

SEQ ID NO: 1392362 - protein, 9 aa, Homo Sapiens
VDAGDQPGA

SEQ ID NO: 1392363 - protein, 9 aa, Homo Sapiens
QTCTLFSWH

SEQ ID NO: 1392364 - protein, 9 aa, Homo Sapiens
PATFHAGTA

SEQ ID NO: 1392365 - protein, 9 aa, Homo Sapiens
ITSSTDPTH

SEQ ID NO: 1392366 - protein, 9 aa, Homo Sapiens
DDANLCKNE

SEQ ID NO: 1392367 - protein, 9 aa, Homo Sapiens
KCGRVEGLL

SEQ ID NO: 1392368 - protein, 9 aa, Homo Sapiens
DSLSDKSSH

SEQ ID NO: 1392369 - protein, 9 aa, Homo Sapiens
FEKAAPRPC

SEQ ID NO: 1392370 - protein, 9 aa, Homo Sapiens
NFFQMVISN

SEQ ID NO: 1392371 - protein, 9 aa, Homo Sapiens
FQLIIIPFR

SEQ ID NO: 1392372 - protein, 9 aa, Homo Sapiens
GIQVTATNP

SEQ ID NO: 1392373 - protein, 9 aa, Homo Sapiens
PQPFLRVLE

SEQ ID NO: 1392374 - protein, 9 aa, Homo Sapiens
SGEQIPGLL

SEQ ID NO: 1392375 - protein, 9 aa, Homo Sapiens
LTINDVGPV

SEQ ID NO: 1392376 - protein, 9 aa, Homo Sapiens
PPLSRARSV

SEQ ID NO: 1392377 - protein, 9 aa, Homo Sapiens
KKNGIWEVM

SEQ ID NO: 1392378 - protein, 9 aa, Homo Sapiens
VMITWKEIP

SEQ ID NO: 1392379 - protein, 9 aa, Homo Sapiens
RIEERYRPN

SEQ ID NO: 1392380 - protein, 9 aa, Homo Sapiens
YMMDFLMSH

SEQ ID NO: 1392381 - protein, 9 aa, Homo Sapiens
IDRVTIYSP

SEQ ID NO: 1392382 - protein, 9 aa, Homo Sapiens
GFLTEDKKN

SEQ ID NO: 1392383 - protein, 9 aa, Homo Sapiens
TIYGAETRK

SEQ ID NO: 1392384 - protein, 9 aa, Homo Sapiens
GDGPWGRSR

SEQ ID NO: 1392385 - protein, 9 aa, Homo Sapiens
QDWQNLVTF

SEQ ID NO: 1392386 - protein, 9 aa, Homo Sapiens
LKRDPQQGQ

SEQ ID NO: 1392387 - protein, 9 aa, Homo Sapiens
LNVIDLMEP

SEQ ID NO: 1392388 - protein, 9 aa, Homo Sapiens
CPRCWKYTT

SEQ ID NO: 1392389 - protein, 9 aa, Homo Sapiens
SSSLSLLAS

SEQ ID NO: 1392390 - protein, 9 aa, Homo Sapiens
RCRECDKAF

SEQ ID NO: 1392391 - protein, 9 aa, Homo Sapiens
FGTTCDIQT

SEQ ID NO: 1392392 - protein, 9 aa, Homo Sapiens
PVESHPHGS

SEQ ID NO: 1392393 - protein, 9 aa, Homo Sapiens
FSRCSWISS

SEQ ID NO: 1392394 - protein, 9 aa, Homo Sapiens
CLICDIDRY

SEQ ID NO: 1392395 - protein, 9 aa, Homo Sapiens
TLEGCISVK

SEQ ID NO: 1392396 - protein, 9 aa, Homo Sapiens
KVWAGLSAQ

SEQ ID NO: 1392397 - protein, 9 aa, Homo Sapiens
SRKAYLPQE

SEQ ID NO: 1392398 - protein, 9 aa, Homo Sapiens
SLLILICDQ

SEQ ID NO: 1392399 - protein, 9 aa, Homo Sapiens
NPELPGVDF

SEQ ID NO: 1392400 - protein, 9 aa, Homo Sapiens
HEKKSLRWT

SEQ ID NO: 1392401 - protein, 9 aa, Homo Sapiens
FQLQLCQKE

SEQ ID NO: 1392402 - protein, 9 aa, Homo Sapiens
QLCQKEQSL

SEQ ID NO: 1392403 - protein, 9 aa, Homo Sapiens
RDMMLENYR

SEQ ID NO: 1392404 - protein, 9 aa, Homo Sapiens
ALQVMGMQR

SEQ ID NO: 1392405 - protein, 9 aa, Homo Sapiens
LEGLDMRPF

SEQ ID NO: 1392406 - protein, 9 aa, Homo Sapiens
MELFVQQPE

SEQ ID NO: 1392407 - protein, 9 aa, Homo Sapiens
KYPIQDTKL

SEQ ID NO: 1392408 - protein, 9 aa, Homo Sapiens
DYILPVLLF

SEQ ID NO: 1392409 - protein, 9 aa, Homo Sapiens
ASAGPPAGA

SEQ ID NO: 1392410 - protein, 9 aa, Homo Sapiens
QVVVMQREL

SEQ ID NO: 1392411 - protein, 9 aa, Homo Sapiens
DNDAGALSQ

SEQ ID NO: 1392412 - protein, 9 aa, Homo Sapiens
VHAIRGEEA

SEQ ID NO: 1392413 - protein, 9 aa, Homo Sapiens
KCYEGTCSK

SEQ ID NO: 1392414 - protein, 9 aa, Homo Sapiens
IASVRPVED

SEQ ID NO: 1392415 - protein, 9 aa, Homo Sapiens
PLEKCYEGT

SEQ ID NO: 1392416 - protein, 9 aa, Homo Sapiens
SQPPTLPWT

SEQ ID NO: 1392417 - protein, 9 aa, Homo Sapiens
CCSWHLPTI

SEQ ID NO: 1392418 - protein, 9 aa, Homo Sapiens
RFCGREYVQ

SEQ ID NO: 1392419 - protein, 9 aa, Homo Sapiens
RHKKQSQSR

SEQ ID NO: 1392420 - protein, 9 aa, Homo Sapiens
SEVSLFTPR

SEQ ID NO: 1392421 - protein, 9 aa, Homo Sapiens
HHWNQRGSH

SEQ ID NO: 1392422 - protein, 9 aa, Homo Sapiens
LASHHSVSC

SEQ ID NO: 1392423 - protein, 9 aa, Homo Sapiens
GGVIKAGQA

SEQ ID NO: 1392424 - protein, 9 aa, Homo Sapiens
PTSLPMTQP

SEQ ID NO: 1392425 - protein, 9 aa, Homo Sapiens
YVACGGLYN

SEQ ID NO: 1392426 - protein, 9 aa, Homo Sapiens
QPHHLPQQM

SEQ ID NO: 1392427 - protein, 9 aa, Homo Sapiens
GVSPPFTAR

SEQ ID NO: 1392428 - protein, 9 aa, Homo Sapiens
AIWRRIGAT

SEQ ID NO: 1392429 - protein, 9 aa, Homo Sapiens
GTNGTEEQM

SEQ ID NO: 1392430 - protein, 9 aa, Homo Sapiens
PLRTTMKRP

SEQ ID NO: 1392431 - protein, 9 aa, Homo Sapiens
LSKVIPQKP

SEQ ID NO: 1392432 - protein, 9 aa, Homo Sapiens
HLYSLSVDH

SEQ ID NO: 1392433 - protein, 9 aa, Homo Sapiens
HYWEEKEQT

SEQ ID NO: 1392434 - protein, 9 aa, Homo Sapiens
MLKAIEMFH

SEQ ID NO: 1392435 - protein, 9 aa, Homo Sapiens
RRTSLSARR

SEQ ID NO: 1392436 - protein, 9 aa, Homo Sapiens
NSNSGVMCL

SEQ ID NO: 1392437 - protein, 9 aa, Homo Sapiens
TFSPVIEYS

SEQ ID NO: 1392438 - protein, 9 aa, Homo Sapiens
VTATNPSMR

SEQ ID NO: 1392439 - protein, 9 aa, Homo Sapiens
CWKYTTESS

SEQ ID NO: 1392440 - protein, 9 aa, Homo Sapiens
PPRARPGTC

SEQ ID NO: 1392441 - protein, 9 aa, Homo Sapiens
IIQRMHLCQ

SEQ ID NO: 1392442 - protein, 9 aa, Homo Sapiens
GDGKKMDLD

SEQ ID NO: 1392443 - protein, 9 aa, Homo Sapiens
LSLLASHHS

SEQ ID NO: 1392444 - protein, 9 aa, Homo Sapiens
VQPVTKTIT

SEQ ID NO: 1392445 - protein, 9 aa, Homo Sapiens
ATGPPPAVG

SEQ ID NO: 1392446 - protein, 9 aa, Homo Sapiens
AGSYIIMVL

SEQ ID NO: 1392447 - protein, 9 aa, Homo Sapiens
RRNGSCRRW

SEQ ID NO: 1392448 - protein, 9 aa, Homo Sapiens
QQQQQPHHL

SEQ ID NO: 1392449 - protein, 9 aa, Homo Sapiens
FLIQRELLK

SEQ ID NO: 1392450 - protein, 9 aa, Homo Sapiens
FQMLPSSCP

SEQ ID NO: 1392451 - protein, 9 aa, Homo Sapiens
VRQDLSSPS

SEQ ID NO: 1392452 - protein, 9 aa, Homo Sapiens
ENGPETSDP

SEQ ID NO: 1392453 - protein, 9 aa, Homo Sapiens
FPQCTFFFL

SEQ ID NO: 1392454 - protein, 9 aa, Homo Sapiens
MGVKMEATP

SEQ ID NO: 1392455 - protein, 9 aa, Homo Sapiens
KQSVFSAPA

SEQ ID NO: 1392456 - protein, 9 aa, Homo Sapiens
LLEVIASLP

SEQ ID NO: 1392457 - protein, 9 aa, Homo Sapiens
LHPLPKRQE

SEQ ID NO: 1392458 - protein, 9 aa, Homo Sapiens
TPALRTLTE

SEQ ID NO: 1392459 - protein, 9 aa, Homo Sapiens
IMASAQPTA

SEQ ID NO: 1392460 - protein, 9 aa, Homo Sapiens
LRLLEEQWG

SEQ ID NO: 1392461 - protein, 9 aa, Homo Sapiens
YSRAVLVER

SEQ ID NO: 1392462 - protein, 9 aa, Homo Sapiens
GSSGGAGCG

SEQ ID NO: 1392463 - protein, 9 aa, Homo Sapiens
CKTSGKAKS

SEQ ID NO: 1392464 - protein, 9 aa, Homo Sapiens
TFHAGTASH

SEQ ID NO: 1392465 - protein, 9 aa, Homo Sapiens
RRRRRRERR

SEQ ID NO: 1392466 - protein, 9 aa, Homo Sapiens
IIRRRLPFS

SEQ ID NO: 1392467 - protein, 9 aa, Homo Sapiens
MENEGASSP

SEQ ID NO: 1392468 - protein, 9 aa, Homo Sapiens
QAAWPRGEQ

SEQ ID NO: 1392469 - protein, 9 aa, Homo Sapiens
GDGDAHSSG

SEQ ID NO: 1392470 - protein, 9 aa, Homo Sapiens
MSPASSPAP

SEQ ID NO: 1392471 - protein, 9 aa, Homo Sapiens
VDTSGLWFT

SEQ ID NO: 1392472 - protein, 9 aa, Homo Sapiens
QESQGGVIK

SEQ ID NO: 1392473 - protein, 9 aa, Homo Sapiens
QHFTGPKAP

SEQ ID NO: 1392474 - protein, 9 aa, Homo Sapiens
SKLGIRGSW

SEQ ID NO: 1392475 - protein, 9 aa, Homo Sapiens
NNLKNCIYP

SEQ ID NO: 1392476 - protein, 9 aa, Homo Sapiens
PSPPGAPLP

SEQ ID NO: 1392477 - protein, 9 aa, Homo Sapiens
GSPLLSGAR

SEQ ID NO: 1392478 - protein, 9 aa, Homo Sapiens
ILPDEIYHV

SEQ ID NO: 1392479 - protein, 9 aa, Homo Sapiens
TGAEADGPK

SEQ ID NO: 1392480 - protein, 9 aa, Homo Sapiens
EPQNQNFQE

SEQ ID NO: 1392481 - protein, 9 aa, Homo Sapiens
SSPLPSSTG

SEQ ID NO: 1392482 - protein, 9 aa, Homo Sapiens
DIGAELDDD

SEQ ID NO: 1392483 - protein, 9 aa, Homo Sapiens
NSESMKKVK

SEQ ID NO: 1392484 - protein, 9 aa, Homo Sapiens
PPLPTASGL

SEQ ID NO: 1392485 - protein, 9 aa, Homo Sapiens
MHPYYLPNL

SEQ ID NO: 1392486 - protein, 9 aa, Homo Sapiens
PDHIRVQAQ

SEQ ID NO: 1392487 - protein, 9 aa, Homo Sapiens
VGNFLHVNT

SEQ ID NO: 1392488 - protein, 9 aa, Homo Sapiens
QSLVARGMG

SEQ ID NO: 1392489 - protein, 9 aa, Homo Sapiens
WEDASVGWL

SEQ ID NO: 1392490 - protein, 9 aa, Homo Sapiens
SYPLPKFTS

SEQ ID NO: 1392491 - protein, 9 aa, Homo Sapiens
RHRDRHFGW

SEQ ID NO: 1392492 - protein, 9 aa, Homo Sapiens
PACWISSSL

SEQ ID NO: 1392493 - protein, 9 aa, Homo Sapiens
VIGKTDPNS

SEQ ID NO: 1392494 - protein, 9 aa, Homo Sapiens
AARIIYPQR

SEQ ID NO: 1392495 - protein, 9 aa, Homo Sapiens
CNPSDRQDW

SEQ ID NO: 1392496 - protein, 9 aa, Homo Sapiens
ETRKESRGA

SEQ ID NO: 1392497 - protein, 9 aa, Homo Sapiens
RTAGSTASV

SEQ ID NO: 1392498 - protein, 9 aa, Homo Sapiens
KVAVQAVQT

SEQ ID NO: 1392499 - protein, 9 aa, Homo Sapiens
RSCSEAASL

SEQ ID NO: 1392500 - protein, 9 aa, Homo Sapiens
PIRLLVPTQ

SEQ ID NO: 1392501 - protein, 9 aa, Homo Sapiens
LWRPTAIRQ

SEQ ID NO: 1392502 - protein, 9 aa, Homo Sapiens
THLLYYTEF

SEQ ID NO: 1392503 - protein, 9 aa, Homo Sapiens
SETARTMLC

SEQ ID NO: 1392504 - protein, 9 aa, Homo Sapiens
KLAQESGHK

SEQ ID NO: 1392505 - protein, 9 aa, Homo Sapiens
PEPGHTGCF

SEQ ID NO: 1392506 - protein, 9 aa, Homo Sapiens
TNTSHIMQY

SEQ ID NO: 1392507 - protein, 9 aa, Homo Sapiens
DNGAAQMGT

SEQ ID NO: 1392508 - protein, 9 aa, Homo Sapiens
DSPPLQDGS

SEQ ID NO: 1392509 - protein, 9 aa, Homo Sapiens
LDIVPHLLL

SEQ ID NO: 1392510 - protein, 9 aa, Homo Sapiens
NHDHPDQRE

SEQ ID NO: 1392511 - protein, 9 aa, Homo Sapiens
VLRAYPIQV

SEQ ID NO: 1392512 - protein, 9 aa, Homo Sapiens
FSGEATHCK

SEQ ID NO: 1392513 - protein, 9 aa, Homo Sapiens
LTEGPPRTR

SEQ ID NO: 1392514 - protein, 9 aa, Homo Sapiens
AFYHHRLII

SEQ ID NO: 1392515 - protein, 9 aa, Homo Sapiens
AVYLVRFYL

SEQ ID NO: 1392516 - protein, 9 aa, Homo Sapiens
LCPGHVSVM

SEQ ID NO: 1392517 - protein, 9 aa, Homo Sapiens
ASGAPGLAM

SEQ ID NO: 1392518 - protein, 9 aa, Homo Sapiens
LTHLPNGLL

SEQ ID NO: 1392519 - protein, 9 aa, Homo Sapiens
IPQSSSSSR

SEQ ID NO: 1392520 - protein, 9 aa, Homo Sapiens
WSTRGRSVR

SEQ ID NO: 1392521 - protein, 9 aa, Homo Sapiens
KNGLHTSPP

SEQ ID NO: 1392522 - protein, 9 aa, Homo Sapiens
DTALAFRVR

SEQ ID NO: 1392523 - protein, 9 aa, Homo Sapiens
KKQSQSRPR

SEQ ID NO: 1392524 - protein, 9 aa, Homo Sapiens
TSAGRYVCE

SEQ ID NO: 1392525 - protein, 9 aa, Homo Sapiens
RGCRNYPNT

SEQ ID NO: 1392526 - protein, 9 aa, Homo Sapiens
NFLHVNTLS

SEQ ID NO: 1392527 - protein, 9 aa, Homo Sapiens
NVIDLMEPT

SEQ ID NO: 1392528 - protein, 9 aa, Homo Sapiens
MYHHSRPVF

SEQ ID NO: 1392529 - protein, 9 aa, Homo Sapiens
WHPAIPAHP

SEQ ID NO: 1392530 - protein, 9 aa, Homo Sapiens
MPEVDKYGM

SEQ ID NO: 1392531 - protein, 9 aa, Homo Sapiens
KIKIGKKHQ

SEQ ID NO: 1392532 - protein, 9 aa, Homo Sapiens
VNMDHSISI

SEQ ID NO: 1392533 - protein, 9 aa, Homo Sapiens
WTLRKQPQG

SEQ ID NO: 1392534 - protein, 9 aa, Homo Sapiens
CKPEMGLPP

SEQ ID NO: 1392535 - protein, 9 aa, Homo Sapiens
ADDEDGLEQ

SEQ ID NO: 1392536 - protein, 9 aa, Homo Sapiens
PRVPRFSSP

SEQ ID NO: 1392537 - protein, 9 aa, Homo Sapiens
YANLSSSST

SEQ ID NO: 1392538 - protein, 9 aa, Homo Sapiens
SQRSAEQSP

SEQ ID NO: 1392539 - protein, 9 aa, Homo Sapiens
DKYGMVAPH

SEQ ID NO: 1392540 - protein, 9 aa, Homo Sapiens
HTNRVCSLQ

SEQ ID NO: 1392541 - protein, 9 aa, Homo Sapiens
QPQGPSCSR

SEQ ID NO: 1392542 - protein, 9 aa, Homo Sapiens
EPPLPTASG

SEQ ID NO: 1392543 - protein, 9 aa, Homo Sapiens
EAFTEAWGA

SEQ ID NO: 1392544 - protein, 9 aa, Homo Sapiens
PKITSPLNV

SEQ ID NO: 1392545 - protein, 9 aa, Homo Sapiens
PRLCRQLAL

SEQ ID NO: 1392546 - protein, 9 aa, Homo Sapiens
TGVVDPGKA

SEQ ID NO: 1392547 - protein, 9 aa, Homo Sapiens
LKFLSPQWA

SEQ ID NO: 1392548 - protein, 9 aa, Homo Sapiens
ASEHACTAL

SEQ ID NO: 1392549 - protein, 9 aa, Homo Sapiens
PPPYSESDS

SEQ ID NO: 1392550 - protein, 9 aa, Homo Sapiens
GPSVLSQVQ

SEQ ID NO: 1392551 - protein, 9 aa, Homo Sapiens
QVTATNPSM

SEQ ID NO: 1392552 - protein, 9 aa, Homo Sapiens
PILEIPTVN

SEQ ID NO: 1392553 - protein, 9 aa, Homo Sapiens
PPPELTVVT

SEQ ID NO: 1392554 - protein, 9 aa, Homo Sapiens
LYCMKVLVL

SEQ ID NO: 1392555 - protein, 9 aa, Homo Sapiens
DNTGQLVFL

SEQ ID NO: 1392556 - protein, 9 aa, Homo Sapiens
HLQTLLENG

SEQ ID NO: 1392557 - protein, 9 aa, Homo Sapiens
QALLAGSRT

SEQ ID NO: 1392558 - protein, 9 aa, Homo Sapiens
PTASGLKNI

SEQ ID NO: 1392559 - protein, 9 aa, Homo Sapiens
LLYVNTVTL

SEQ ID NO: 1392560 - protein, 9 aa, Homo Sapiens
RTEMQLWRQ

SEQ ID NO: 1392561 - protein, 9 aa, Homo Sapiens
CCCTSDVGW

SEQ ID NO: 1392562 - protein, 9 aa, Homo Sapiens
SDRRRPSRD

SEQ ID NO: 1392563 - protein, 9 aa, Homo Sapiens
WCMASMSFG

SEQ ID NO: 1392564 - protein, 9 aa, Homo Sapiens
EKSFVDNFV

SEQ ID NO: 1392565 - protein, 9 aa, Homo Sapiens
ATLDACSCG

SEQ ID NO: 1392566 - protein, 9 aa, Homo Sapiens
CPLPPQVPT

SEQ ID NO: 1392567 - protein, 9 aa, Homo Sapiens
TPPRSSPKP

SEQ ID NO: 1392568 - protein, 9 aa, Homo Sapiens
EPKEEEEDD

SEQ ID NO: 1392569 - protein, 9 aa, Homo Sapiens
ILVTGQMWV

SEQ ID NO: 1392570 - protein, 9 aa, Homo Sapiens
QPSQQLRKP

SEQ ID NO: 1392571 - protein, 9 aa, Homo Sapiens
TAELFVLSY

SEQ ID NO: 1392572 - protein, 9 aa, Homo Sapiens
DRDTQLTRL

SEQ ID NO: 1392573 - protein, 9 aa, Homo Sapiens
GKAFLPERK

SEQ ID NO: 1392574 - protein, 9 aa, Homo Sapiens
YMFNSNSGV

SEQ ID NO: 1392575 - protein, 9 aa, Homo Sapiens
TWQRRLRAC

SEQ ID NO: 1392576 - protein, 9 aa, Homo Sapiens
LEGQFMYHH

SEQ ID NO: 1392577 - protein, 9 aa, Homo Sapiens
PLSSKLGIR

SEQ ID NO: 1392578 - protein, 9 aa, Homo Sapiens
VACGGLYNI

SEQ ID NO: 1392579 - protein, 9 aa, Homo Sapiens
ASRSWAWTC

SEQ ID NO: 1392580 - protein, 9 aa, Homo Sapiens
LGYPVVDKG

SEQ ID NO: 1392581 - protein, 9 aa, Homo Sapiens
LLLVYIMST

SEQ ID NO: 1392582 - protein, 9 aa, Homo Sapiens
KVLQKGKKR

SEQ ID NO: 1392583 - protein, 9 aa, Homo Sapiens
GPTPTEPPL

SEQ ID NO: 1392584 - protein, 9 aa, Homo Sapiens
GTAPSAVPS

SEQ ID NO: 1392585 - protein, 9 aa, Homo Sapiens
LVLVLFLLL

SEQ ID NO: 1392586 - protein, 9 aa, Homo Sapiens
PSLQQTLRG

SEQ ID NO: 1392587 - protein, 9 aa, Homo Sapiens
TESSRQTLQ

SEQ ID NO: 1392588 - protein, 9 aa, Homo Sapiens
VASMYTQMP

SEQ ID NO: 1392589 - protein, 9 aa, Homo Sapiens
RPALLLLPP

SEQ ID NO: 1392590 - protein, 9 aa, Homo Sapiens
ACKVWAGLS

SEQ ID NO: 1392591 - protein, 9 aa, Homo Sapiens
SLVDNDLDS

SEQ ID NO: 1392592 - protein, 9 aa, Homo Sapiens
STSHHLVSM

SEQ ID NO: 1392593 - protein, 9 aa, Homo Sapiens
SWEKSFVDN

SEQ ID NO: 1392594 - protein, 9 aa, Homo Sapiens
PASSASSKE

SEQ ID NO: 1392595 - protein, 9 aa, Homo Sapiens
EMKNLNFSV

SEQ ID NO: 1392596 - protein, 9 aa, Homo Sapiens
QNLVYLATI

SEQ ID NO: 1392597 - protein, 9 aa, Homo Sapiens
TSAQSLHPV

SEQ ID NO: 1392598 - protein, 9 aa, Homo Sapiens
RRTHVYIAS

SEQ ID NO: 1392599 - protein, 9 aa, Homo Sapiens
PRMGPVSPA

SEQ ID NO: 1392600 - protein, 9 aa, Homo Sapiens
PWKNSESMK

SEQ ID NO: 1392601 - protein, 9 aa, Homo Sapiens
RVPAPLLTW

SEQ ID NO: 1392602 - protein, 9 aa, Homo Sapiens
FLLHQPLPG

SEQ ID NO: 1392603 - protein, 9 aa, Homo Sapiens
LRLKEDKKI

SEQ ID NO: 1392604 - protein, 9 aa, Homo Sapiens
TSLPMTQPS

SEQ ID NO: 1392605 - protein, 9 aa, Homo Sapiens
TLLLTSTPE

SEQ ID NO: 1392606 - protein, 9 aa, Homo Sapiens
VCGYSGSGS

SEQ ID NO: 1392607 - protein, 9 aa, Homo Sapiens
VFSFFFCLR

SEQ ID NO: 1392608 - protein, 9 aa, Homo Sapiens
YTTESSDTL

SEQ ID NO: 1392609 - protein, 9 aa, Homo Sapiens
WMATMRTQT

SEQ ID NO: 1392610 - protein, 9 aa, Homo Sapiens
KPLPPNTKD

SEQ ID NO: 1392611 - protein, 9 aa, Homo Sapiens
LRNCIPAPV

SEQ ID NO: 1392612 - protein, 9 aa, Homo Sapiens
EHLQALFQV

SEQ ID NO: 1392613 - protein, 9 aa, Homo Sapiens
RATVPRHSS

SEQ ID NO: 1392614 - protein, 9 aa, Homo Sapiens
PRGEQESQG

SEQ ID NO: 1392615 - protein, 9 aa, Homo Sapiens
ARKPHSPPR

SEQ ID NO: 1392616 - protein, 9 aa, Homo Sapiens
FAEQDVKEE

SEQ ID NO: 1392617 - protein, 9 aa, Homo Sapiens
GPRIKCVWN

SEQ ID NO: 1392618 - protein, 9 aa, Homo Sapiens
KAQTMNSFL

SEQ ID NO: 1392619 - protein, 9 aa, Homo Sapiens
RGGCPGLVP

SEQ ID NO: 1392620 - protein, 9 aa, Homo Sapiens
QGTASPTTP

SEQ ID NO: 1392621 - protein, 9 aa, Homo Sapiens
GPPTLGQRP

SEQ ID NO: 1392622 - protein, 9 aa, Homo Sapiens
AGYRSCAVN

SEQ ID NO: 1392623 - protein, 9 aa, Homo Sapiens
PLPPQVPTS

SEQ ID NO: 1392624 - protein, 9 aa, Homo Sapiens
GFLSRPAWC

SEQ ID NO: 1392625 - protein, 9 aa, Homo Sapiens
ASCTTQRIL

SEQ ID NO: 1392626 - protein, 9 aa, Homo Sapiens
TSDVGWGDN

SEQ ID NO: 1392627 - protein, 9 aa, Homo Sapiens
MGRPPAASG

SEQ ID NO: 1392628 - protein, 9 aa, Homo Sapiens
SKVIPQKPN

SEQ ID NO: 1392629 - protein, 9 aa, Homo Sapiens
CRLYSGYLI

SEQ ID NO: 1392630 - protein, 9 aa, Homo Sapiens
KTAGKPWLL

SEQ ID NO: 1392631 - protein, 9 aa, Homo Sapiens
EDTEAEKGK

SEQ ID NO: 1392632 - protein, 9 aa, Homo Sapiens
RSAAAASPR

SEQ ID NO: 1392633 - protein, 9 aa, Homo Sapiens
SHHSGDWWG

SEQ ID NO: 1392634 - protein, 9 aa, Homo Sapiens
GSPAGRSGV

SEQ ID NO: 1392635 - protein, 9 aa, Homo Sapiens
GILGSTGCS

SEQ ID NO: 1392636 - protein, 9 aa, Homo Sapiens
AFGYGVGHG

SEQ ID NO: 1392637 - protein, 9 aa, Homo Sapiens
FQVATTEME

SEQ ID NO: 1392638 - protein, 9 aa, Homo Sapiens
GYGNSQGTV

SEQ ID NO: 1392639 - protein, 9 aa, Homo Sapiens
LPQDVCQGS

SEQ ID NO: 1392640 - protein, 9 aa, Homo Sapiens
ALHGVTEGN

SEQ ID NO: 1392641 - protein, 9 aa, Homo Sapiens
NLRVDAGDQ

SEQ ID NO: 1392642 - protein, 9 aa, Homo Sapiens
LEVIASLPD

SEQ ID NO: 1392643 - protein, 9 aa, Homo Sapiens
CYGHGVGRI

SEQ ID NO: 1392644 - protein, 9 aa, Homo Sapiens
QALRFQGPA

SEQ ID NO: 1392645 - protein, 9 aa, Homo Sapiens
PFGPVENKI

SEQ ID NO: 1392646 - protein, 9 aa, Homo Sapiens
KRISATTQC

SEQ ID NO: 1392647 - protein, 9 aa, Homo Sapiens
VRRLPKPAK

SEQ ID NO: 1392648 - protein, 9 aa, Homo Sapiens
GGSSYSCGS

SEQ ID NO: 1392649 - protein, 9 aa, Homo Sapiens
SNRQNKKVV

SEQ ID NO: 1392650 - protein, 9 aa, Homo Sapiens
GSNSWVNSH

SEQ ID NO: 1392651 - protein, 9 aa, Homo Sapiens
PWLPQGHQG

SEQ ID NO: 1392652 - protein, 9 aa, Homo Sapiens
PTANGLHLS

SEQ ID NO: 1392653 - protein, 9 aa, Homo Sapiens
DVMCYTASI

SEQ ID NO: 1392654 - protein, 9 aa, Homo Sapiens
SQPVQEAEV

SEQ ID NO: 1392655 - protein, 9 aa, Homo Sapiens
TILDDEPVI

SEQ ID NO: 1392656 - protein, 9 aa, Homo Sapiens
EEVCGTGVR

SEQ ID NO: 1392657 - protein, 9 aa, Homo Sapiens
GSVALRDNH

SEQ ID NO: 1392658 - protein, 9 aa, Homo Sapiens
QQLRKPRRR

SEQ ID NO: 1392659 - protein, 9 aa, Homo Sapiens
KTFLPVKGI

SEQ ID NO: 1392660 - protein, 9 aa, Homo Sapiens
YEEAHYYQL

SEQ ID NO: 1392661 - protein, 9 aa, Homo Sapiens
TKLPASRSI

SEQ ID NO: 1392662 - protein, 9 aa, Homo Sapiens
PSMPGPKKA

SEQ ID NO: 1392663 - protein, 9 aa, Homo Sapiens
WQVLFMNIQ

SEQ ID NO: 1392664 - protein, 9 aa, Homo Sapiens
IDRERRATR

SEQ ID NO: 1392665 - protein, 9 aa, Homo Sapiens
DEIGNHYME

SEQ ID NO: 1392666 - protein, 9 aa, Homo Sapiens
PPAGAFGEA

SEQ ID NO: 1392667 - protein, 9 aa, Homo Sapiens
RAPSCTARA

SEQ ID NO: 1392668 - protein, 9 aa, Homo Sapiens
PGAIEASVK

SEQ ID NO: 1392669 - protein, 9 aa, Homo Sapiens
TAVHAIRGE

SEQ ID NO: 1392670 - protein, 9 aa, Homo Sapiens
NHPWSICFL

SEQ ID NO: 1392671 - protein, 9 aa, Homo Sapiens
LKIYLQTTD

SEQ ID NO: 1392672 - protein, 9 aa, Homo Sapiens
ETPVAESPA

SEQ ID NO: 1392673 - protein, 9 aa, Homo Sapiens
VGALLQQRH

SEQ ID NO: 1392674 - protein, 9 aa, Homo Sapiens
TVAHQITLL

SEQ ID NO: 1392675 - protein, 9 aa, Homo Sapiens
TAATTAAGA

SEQ ID NO: 1392676 - protein, 9 aa, Homo Sapiens
MLCFWTPHS

SEQ ID NO: 1392677 - protein, 9 aa, Homo Sapiens
LSSLPCFLE

SEQ ID NO: 1392678 - protein, 9 aa, Homo Sapiens
KKGLPVGFI

SEQ ID NO: 1392679 - protein, 9 aa, Homo Sapiens
TSTSVSRHS

SEQ ID NO: 1392680 - protein, 9 aa, Homo Sapiens
GFATRGWRA

SEQ ID NO: 1392681 - protein, 9 aa, Homo Sapiens
ACTPASGPS

SEQ ID NO: 1392682 - protein, 9 aa, Homo Sapiens
MQQGGAPSA

SEQ ID NO: 1392683 - protein, 9 aa, Homo Sapiens
GNGWWGQKT

SEQ ID NO: 1392684 - protein, 9 aa, Homo Sapiens
QWATINTSP

SEQ ID NO: 1392685 - protein, 9 aa, Homo Sapiens
ASGLKNIPG

SEQ ID NO: 1392686 - protein, 9 aa, Homo Sapiens
YPHSAWCVY

SEQ ID NO: 1392687 - protein, 9 aa, Homo Sapiens
LADYPAVPR

SEQ ID NO: 1392688 - protein, 9 aa, Homo Sapiens
SGCVFIIKS

SEQ ID NO: 1392689 - protein, 9 aa, Homo Sapiens
NVRDSVTKG

SEQ ID NO: 1392690 - protein, 9 aa, Homo Sapiens
VPLPLCGYP

SEQ ID NO: 1392691 - protein, 9 aa, Homo Sapiens
SCTTQRILA

SEQ ID NO: 1392692 - protein, 9 aa, Homo Sapiens
VACLVLTDF

SEQ ID NO: 1392693 - protein, 9 aa, Homo Sapiens
GTMPLLHIR

SEQ ID NO: 1392694 - protein, 9 aa, Homo Sapiens
AMRERIRVE

SEQ ID NO: 1392695 - protein, 9 aa, Homo Sapiens
ILLTLLLTS

SEQ ID NO: 1392696 - protein, 9 aa, Homo Sapiens
TRLWMATMR

SEQ ID NO: 1392697 - protein, 9 aa, Homo Sapiens
ERRQSASCG

SEQ ID NO: 1392698 - protein, 9 aa, Homo Sapiens
VKNHDHPDQ

SEQ ID NO: 1392699 - protein, 9 aa, Homo Sapiens
DHPDQREGD

SEQ ID NO: 1392700 - protein, 9 aa, Homo Sapiens
IAAACIHMM

SEQ ID NO: 1392701 - protein, 9 aa, Homo Sapiens
GAASRSWAW

SEQ ID NO: 1392702 - protein, 9 aa, Homo Sapiens
AHPCPLPPQ

SEQ ID NO: 1392703 - protein, 9 aa, Homo Sapiens
KCRRPRGGL

SEQ ID NO: 1392704 - protein, 9 aa, Homo Sapiens
KERRPRKKP

SEQ ID NO: 1392705 - protein, 9 aa, Homo Sapiens
LRKQPQGPS

SEQ ID NO: 1392706 - protein, 9 aa, Homo Sapiens
WAGLSAQLA

SEQ ID NO: 1392707 - protein, 9 aa, Homo Sapiens
FVLSYQDPA

SEQ ID NO: 1392708 - protein, 9 aa, Homo Sapiens
TVSDNDAGA

SEQ ID NO: 1392709 - protein, 9 aa, Homo Sapiens
PPLSVPTIL

SEQ ID NO: 1392710 - protein, 9 aa, Homo Sapiens
HQRSRRHRD

SEQ ID NO: 1392711 - protein, 9 aa, Homo Sapiens
TGMGRPPAA

SEQ ID NO: 1392712 - protein, 9 aa, Homo Sapiens
PAATSAQSL

SEQ ID NO: 1392713 - protein, 9 aa, Homo Sapiens
LPVQPVTKT

SEQ ID NO: 1392714 - protein, 9 aa, Homo Sapiens
FQMMEGKAF

SEQ ID NO: 1392715 - protein, 9 aa, Homo Sapiens
CISVNTGEL

SEQ ID NO: 1392716 - protein, 9 aa, Homo Sapiens
RQTLQNSQF

SEQ ID NO: 1392717 - protein, 9 aa, Homo Sapiens
NLTGVPGGH

SEQ ID NO: 1392718 - protein, 9 aa, Homo Sapiens
NGSCRRWRA

SEQ ID NO: 1392719 - protein, 9 aa, Homo Sapiens
MKSISAALE

SEQ ID NO: 1392720 - protein, 9 aa, Homo Sapiens
QVMGMQRER

SEQ ID NO: 1392721 - protein, 9 aa, Homo Sapiens
HPCSRRAPS

SEQ ID NO: 1392722 - protein, 9 aa, Homo Sapiens
PPPSTAATT

SEQ ID NO: 1392723 - protein, 9 aa, Homo Sapiens
RYAQSRMHW

SEQ ID NO: 1392724 - protein, 9 aa, Homo Sapiens
GITEKSNML

SEQ ID NO: 1392725 - protein, 9 aa, Homo Sapiens
APAKLGSAR

SEQ ID NO: 1392726 - protein, 9 aa, Homo Sapiens
MMDFLMSHP

SEQ ID NO: 1392727 - protein, 9 aa, Homo Sapiens
RLKEDKKIE

SEQ ID NO: 1392728 - protein, 9 aa, Homo Sapiens
SLTLEKKIK

SEQ ID NO: 1392729 - protein, 9 aa, Homo Sapiens
VKTYHGGGA

SEQ ID NO: 1392730 - protein, 9 aa, Homo Sapiens
GALLQQRHS

SEQ ID NO: 1392731 - protein, 9 aa, Homo Sapiens
LPCFLELRQ

SEQ ID NO: 1392732 - protein, 9 aa, Homo Sapiens
NMIQVLMSV

SEQ ID NO: 1392733 - protein, 9 aa, Homo Sapiens
RCSIRKSHV

SEQ ID NO: 1392734 - protein, 9 aa, Homo Sapiens
LVTGQMWVM

SEQ ID NO: 1392735 - protein, 9 aa, Homo Sapiens
CVFIIKSYS

SEQ ID NO: 1392736 - protein, 9 aa, Homo Sapiens
LHGRWRLDS

SEQ ID NO: 1392737 - protein, 9 aa, Homo Sapiens
SLDAMVNYF

SEQ ID NO: 1392738 - protein, 9 aa, Homo Sapiens
THCKYYSTT

SEQ ID NO: 1392739 - protein, 9 aa, Homo Sapiens
QLAVITSNT

SEQ ID NO: 1392740 - protein, 9 aa, Homo Sapiens
GHQGPWHHW

SEQ ID NO: 1392741 - protein, 9 aa, Homo Sapiens
NEDAGFQQQ

SEQ ID NO: 1392742 - protein, 9 aa, Homo Sapiens
PTSQSLRCT

SEQ ID NO: 1392743 - protein, 9 aa, Homo Sapiens
HTFSPVIEY

SEQ ID NO: 1392744 - protein, 9 aa, Homo Sapiens
ATTAAGASG

SEQ ID NO: 1392745 - protein, 9 aa, Homo Sapiens
ASGNGCPDS

SEQ ID NO: 1392746 - protein, 9 aa, Homo Sapiens
CTVFWALIL

SEQ ID NO: 1392747 - protein, 9 aa, Homo Sapiens
GCPRPLSSK

SEQ ID NO: 1392748 - protein, 9 aa, Homo Sapiens
SAAAASPRA

SEQ ID NO: 1392749 - protein, 9 aa, Homo Sapiens
RYIEKSNSV

SEQ ID NO: 1392750 - protein, 9 aa, Homo Sapiens
AKLGSARRS

SEQ ID NO: 1392751 - protein, 9 aa, Homo Sapiens
VPADDEDGL

SEQ ID NO: 1392752 - protein, 9 aa, Homo Sapiens
SVTTWASLA

SEQ ID NO: 1392753 - protein, 9 aa, Homo Sapiens
CNVDLVLVP

SEQ ID NO: 1392754 - protein, 9 aa, Homo Sapiens
PPAVGARRR

SEQ ID NO: 1392755 - protein, 9 aa, Homo Sapiens
VDKHEKKSL

SEQ ID NO: 1392756 - protein, 9 aa, Homo Sapiens
TRRDSWPTR

SEQ ID NO: 1392757 - protein, 9 aa, Homo Sapiens
QLRWPGLPG

SEQ ID NO: 1392758 - protein, 9 aa, Homo Sapiens
TSSTDPTHT

SEQ ID NO: 1392759 - protein, 9 aa, Homo Sapiens
CDYVGGYFG

SEQ ID NO: 1392760 - protein, 9 aa, Homo Sapiens
ITIGASPTQ

SEQ ID NO: 1392761 - protein, 9 aa, Homo Sapiens
TPITGILVD

SEQ ID NO: 1392762 - protein, 9 aa, Homo Sapiens
LATGLHLHR

SEQ ID NO: 1392763 - protein, 9 aa, Homo Sapiens
GGVFSFGTR

SEQ ID NO: 1392764 - protein, 9 aa, Homo Sapiens
SFKAALRSK

SEQ ID NO: 1392765 - protein, 9 aa, Homo Sapiens
ANFFQMVIS

SEQ ID NO: 1392766 - protein, 9 aa, Homo Sapiens
CMDGSDEEV

SEQ ID NO: 1392767 - protein, 9 aa, Homo Sapiens
SSWLPEFIV

SEQ ID NO: 1392768 - protein, 9 aa, Homo Sapiens
QINKPTPND

SEQ ID NO: 1392769 - protein, 9 aa, Homo Sapiens
LLLEVKLKS

SEQ ID NO: 1392770 - protein, 9 aa, Homo Sapiens
LALGSRGGT

SEQ ID NO: 1392771 - protein, 9 aa, Homo Sapiens
VDYGDISLR

SEQ ID NO: 1392772 - protein, 9 aa, Homo Sapiens
LMPAATIAP

SEQ ID NO: 1392773 - protein, 9 aa, Homo Sapiens
SLQQTLRGQ

SEQ ID NO: 1392774 - protein, 9 aa, Homo Sapiens
CQLFKCYDA

SEQ ID NO: 1392775 - protein, 9 aa, Homo Sapiens
DIIQRMHLC

SEQ ID NO: 1392776 - protein, 9 aa, Homo Sapiens
QPVKCGRVE

SEQ ID NO: 1392777 - protein, 9 aa, Homo Sapiens
LMEPTLQLL

SEQ ID NO: 1392778 - protein, 9 aa, Homo Sapiens
GSRRNGSCR

SEQ ID NO: 1392779 - protein, 9 aa, Homo Sapiens
IMALGALLS

SEQ ID NO: 1392780 - protein, 9 aa, Homo Sapiens
YIFGKHIIL

SEQ ID NO: 1392781 - protein, 9 aa, Homo Sapiens
YGNSQGTVF

SEQ ID NO: 1392782 - protein, 9 aa, Homo Sapiens
TRLMRRNSL

SEQ ID NO: 1392783 - protein, 9 aa, Homo Sapiens
LQILHPYNT

SEQ ID NO: 1392784 - protein, 9 aa, Homo Sapiens
RVDAGDQPG

SEQ ID NO: 1392785 - protein, 9 aa, Homo Sapiens
RASLRATVP

SEQ ID NO: 1392786 - protein, 9 aa, Homo Sapiens
ASHHSVSCS

SEQ ID NO: 1392787 - protein, 9 aa, Homo Sapiens
VLMQKCIHL

SEQ ID NO: 1392788 - protein, 9 aa, Homo Sapiens
KITSPLNVI

SEQ ID NO: 1392789 - protein, 9 aa, Homo Sapiens
TALAFRVRR

SEQ ID NO: 1392790 - protein, 9 aa, Homo Sapiens
RRAANHDVG

SEQ ID NO: 1392791 - protein, 9 aa, Homo Sapiens
YYRETYCAC

SEQ ID NO: 1392792 - protein, 9 aa, Homo Sapiens
DTDPRHLVQ

SEQ ID NO: 1392793 - protein, 9 aa, Homo Sapiens
KETKFQLII

SEQ ID NO: 1392794 - protein, 9 aa, Homo Sapiens
APRMRGNLA

SEQ ID NO: 1392795 - protein, 9 aa, Homo Sapiens
AGASLWGPQ

SEQ ID NO: 1392796 - protein, 9 aa, Homo Sapiens
GKKLVKISE

SEQ ID NO: 1392797 - protein, 9 aa, Homo Sapiens
APPPPTPAS

SEQ ID NO: 1392798 - protein, 9 aa, Homo Sapiens
ARGMGGSLG

SEQ ID NO: 1392799 - protein, 9 aa, Homo Sapiens
SQALKDEEE

SEQ ID NO: 1392800 - protein, 9 aa, Homo Sapiens
HLGDGKKMD

SEQ ID NO: 1392801 - protein, 9 aa, Homo Sapiens
AASQVVVMQ

SEQ ID NO: 1392802 - protein, 9 aa, Homo Sapiens
CVASGNGCP

SEQ ID NO: 1392803 - protein, 9 aa, Homo Sapiens
LQASYTPSP

SEQ ID NO: 1392804 - protein, 9 aa, Homo Sapiens
EQFMENEGA

SEQ ID NO: 1392805 - protein, 9 aa, Homo Sapiens
RETIVLQHE

SEQ ID NO: 1392806 - protein, 9 aa, Homo Sapiens
EVLMQKCIH

SEQ ID NO: 1392807 - protein, 9 aa, Homo Sapiens
QQTEKPVWS

SEQ ID NO: 1392808 - protein, 9 aa, Homo Sapiens
LRQGLTFPG

SEQ ID NO: 1392809 - protein, 9 aa, Homo Sapiens
IPSQPPTLP

SEQ ID NO: 1392810 - protein, 9 aa, Homo Sapiens
MTHTGEKLY

SEQ ID NO: 1392811 - protein, 9 aa, Homo Sapiens
RVQMVHFTV

SEQ ID NO: 1392812 - protein, 9 aa, Homo Sapiens
LPGPPTLGQ

SEQ ID NO: 1392813 - protein, 9 aa, Homo Sapiens
LEEPSKALH

SEQ ID NO: 1392814 - protein, 9 aa, Homo Sapiens
AHYPRESSW

SEQ ID NO: 1392815 - protein, 9 aa, Homo Sapiens
LEQDLQHPV

SEQ ID NO: 1392816 - protein, 9 aa, Homo Sapiens
DISEADLVR

SEQ ID NO: 1392817 - protein, 9 aa, Homo Sapiens
QLFKCYDAQ

SEQ ID NO: 1392818 - protein, 9 aa, Homo Sapiens
GQAGHHSQP

SEQ ID NO: 1392819 - protein, 9 aa, Homo Sapiens
KAPCPGTLS

SEQ ID NO: 1392820 - protein, 9 aa, Homo Sapiens
LLFCTGKVC

SEQ ID NO: 1392821 - protein, 9 aa, Homo Sapiens
LTQKWCMAS

SEQ ID NO: 1392822 - protein, 9 aa, Homo Sapiens
IGQGLVGMT

SEQ ID NO: 1392823 - protein, 9 aa, Homo Sapiens
DPGDIGAEL

SEQ ID NO: 1392824 - protein, 9 aa, Homo Sapiens
HKEIAAACI

SEQ ID NO: 1392825 - protein, 9 aa, Homo Sapiens
QVVNAKKKC

SEQ ID NO: 1392826 - protein, 9 aa, Homo Sapiens
VARPSTTRR

SEQ ID NO: 1392827 - protein, 9 aa, Homo Sapiens
PLLLVYIMS

SEQ ID NO: 1392828 - protein, 9 aa, Homo Sapiens
WTEPYCIIA

SEQ ID NO: 1392829 - protein, 9 aa, Homo Sapiens
LAQAIAVQA

SEQ ID NO: 1392830 - protein, 9 aa, Homo Sapiens
SSLIVTAAS

SEQ ID NO: 1392831 - protein, 9 aa, Homo Sapiens
RWSPCSAAC

SEQ ID NO: 1392832 - protein, 9 aa, Homo Sapiens
VVLCLTSLQ

SEQ ID NO: 1392833 - protein, 9 aa, Homo Sapiens
GQPSDVGSR

SEQ ID NO: 1392834 - protein, 9 aa, Homo Sapiens
PQNQNFQEM

SEQ ID NO: 1392835 - protein, 9 aa, Homo Sapiens
ISTMVSSYR

SEQ ID NO: 1392836 - protein, 9 aa, Homo Sapiens
RQLLHGRWR

SEQ ID NO: 1392837 - protein, 9 aa, Homo Sapiens
RRWSRSPRM

SEQ ID NO: 1392838 - protein, 9 aa, Homo Sapiens
SSHRVLVAH

SEQ ID NO: 1392839 - protein, 9 aa, Homo Sapiens
AGTLLSTHR

SEQ ID NO: 1392840 - protein, 9 aa, Homo Sapiens
ASARSPTSS

SEQ ID NO: 1392841 - protein, 9 aa, Homo Sapiens
MKKDKKETK

SEQ ID NO: 1392842 - protein, 9 aa, Homo Sapiens
CATLEPQNQ

SEQ ID NO: 1392843 - protein, 9 aa, Homo Sapiens
QYGDRYINL

SEQ ID NO: 1392844 - protein, 9 aa, Homo Sapiens
VQAQVYFTQ

SEQ ID NO: 1392845 - protein, 9 aa, Homo Sapiens
PLVQSLHQE

SEQ ID NO: 1392846 - protein, 9 aa, Homo Sapiens
SQVVVMQRE

SEQ ID NO: 1392847 - protein, 9 aa, Homo Sapiens
HTRADLISE

SEQ ID NO: 1392848 - protein, 9 aa, Homo Sapiens
PMYQVKTYH

SEQ ID NO: 1392849 - protein, 9 aa, Homo Sapiens
GQRPRQPSQ

SEQ ID NO: 1392850 - protein, 9 aa, Homo Sapiens
GGTHAFGYG

SEQ ID NO: 1392851 - protein, 9 aa, Homo Sapiens
IPANSEDGG

SEQ ID NO: 1392852 - protein, 9 aa, Homo Sapiens
WAALLLYYL

SEQ ID NO: 1392853 - protein, 9 aa, Homo Sapiens
NSGWLYCMK

SEQ ID NO: 1392854 - protein, 9 aa, Homo Sapiens
LWRQDRGGP

SEQ ID NO: 1392855 - protein, 9 aa, Homo Sapiens
RLFLIIQTT

SEQ ID NO: 1392856 - protein, 9 aa, Homo Sapiens
APSPSVLLS

SEQ ID NO: 1392857 - protein, 9 aa, Homo Sapiens
QGSGGDTRR

SEQ ID NO: 1392858 - protein, 9 aa, Homo Sapiens
HITCRLYSG

SEQ ID NO: 1392859 - protein, 9 aa, Homo Sapiens
TVPDLPPPH

SEQ ID NO: 1392860 - protein, 9 aa, Homo Sapiens
CTFFFLHKE

SEQ ID NO: 1392861 - protein, 9 aa, Homo Sapiens
GATLDACSC

SEQ ID NO: 1392862 - protein, 9 aa, Homo Sapiens
AFELDHTRA

SEQ ID NO: 1392863 - protein, 9 aa, Homo Sapiens
TCSCNPEWL

SEQ ID NO: 1392864 - protein, 9 aa, Homo Sapiens
TRASGPTPV

SEQ ID NO: 1392865 - protein, 9 aa, Homo Sapiens
ILSVALDIL

SEQ ID NO: 1392866 - protein, 9 aa, Homo Sapiens
HTGVKPNEC

SEQ ID NO: 1392867 - protein, 9 aa, Homo Sapiens
VCSLQFDGI

SEQ ID NO: 1392868 - protein, 9 aa, Homo Sapiens
TGLHLHRQI

SEQ ID NO: 1392869 - protein, 9 aa, Homo Sapiens
KEAFTEAWG

SEQ ID NO: 1392870 - protein, 9 aa, Homo Sapiens
AGRYVCENC

SEQ ID NO: 1392871 - protein, 9 aa, Homo Sapiens
PVTWLISLA

SEQ ID NO: 1392872 - protein, 9 aa, Homo Sapiens
AENLLHNHY

SEQ ID NO: 1392873 - protein, 9 aa, Homo Sapiens
PSVARPSTT

SEQ ID NO: 1392874 - protein, 9 aa, Homo Sapiens
PSRRLRSRL

SEQ ID NO: 1392875 - protein, 9 aa, Homo Sapiens
RLRRAANHD

SEQ ID NO: 1392876 - protein, 9 aa, Homo Sapiens
SPAGRSGVL

SEQ ID NO: 1392877 - protein, 9 aa, Homo Sapiens
PHGYTCDYV

SEQ ID NO: 1392878 - protein, 9 aa, Homo Sapiens
SRDTKLPAS

SEQ ID NO: 1392879 - protein, 9 aa, Homo Sapiens
FQQQTEKPV

SEQ ID NO: 1392880 - protein, 9 aa, Homo Sapiens
SVEDANPAG

SEQ ID NO: 1392881 - protein, 9 aa, Homo Sapiens
VEKVKKLLV

SEQ ID NO: 1392882 - protein, 9 aa, Homo Sapiens
AWGRLCVDA

SEQ ID NO: 1392883 - protein, 9 aa, Homo Sapiens
DVASTTHKE

SEQ ID NO: 1392884 - protein, 9 aa, Homo Sapiens
YNHPAEEVI

SEQ ID NO: 1392885 - protein, 9 aa, Homo Sapiens
KDEAFYHHR

SEQ ID NO: 1392886 - protein, 9 aa, Homo Sapiens
LGAQGSGGD

SEQ ID NO: 1392887 - protein, 9 aa, Homo Sapiens
PLLSGARGR

SEQ ID NO: 1392888 - protein, 9 aa, Homo Sapiens
LVRIGSGKY

SEQ ID NO: 1392889 - protein, 9 aa, Homo Sapiens
TASPTTPSQ

SEQ ID NO: 1392890 - protein, 9 aa, Homo Sapiens
PEASGGAWK

SEQ ID NO: 1392891 - protein, 9 aa, Homo Sapiens
CTARAPLPP

SEQ ID NO: 1392892 - protein, 9 aa, Homo Sapiens
VLPLVVLCL

SEQ ID NO: 1392893 - protein, 9 aa, Homo Sapiens
PGHTGCFPC

SEQ ID NO: 1392894 - protein, 9 aa, Homo Sapiens
GMELFVQQP

SEQ ID NO: 1392895 - protein, 9 aa, Homo Sapiens
MSLKVPSAE

SEQ ID NO: 1392896 - protein, 9 aa, Homo Sapiens
VHAQYEEIA

SEQ ID NO: 1392897 - protein, 9 aa, Homo Sapiens
TATAASARS

SEQ ID NO: 1392898 - protein, 9 aa, Homo Sapiens
MLTVIGQGL

SEQ ID NO: 1392899 - protein, 9 aa, Homo Sapiens
PDLPPPHLR

SEQ ID NO: 1392900 - protein, 9 aa, Homo Sapiens
GRLVIVGHG

SEQ ID NO: 1392901 - protein, 9 aa, Homo Sapiens
CSLQFDGIH

SEQ ID NO: 1392902 - protein, 9 aa, Homo Sapiens
TAQIQRPIQ

SEQ ID NO: 1392903 - protein, 9 aa, Homo Sapiens
MMEGKAFLP

SEQ ID NO: 1392904 - protein, 9 aa, Homo Sapiens
HPMLKAIEM

SEQ ID NO: 1392905 - protein, 9 aa, Homo Sapiens
LVVLCLTSL

SEQ ID NO: 1392906 - protein, 9 aa, Homo Sapiens
QGQFIPSQP

SEQ ID NO: 1392907 - protein, 9 aa, Homo Sapiens
GWFFGEQVS

SEQ ID NO: 1392908 - protein, 9 aa, Homo Sapiens
RGRSVRPPV

SEQ ID NO: 1392909 - protein, 9 aa, Homo Sapiens
DAGTLLSTH

SEQ ID NO: 1392910 - protein, 9 aa, Homo Sapiens
PGLITIGAS

SEQ ID NO: 1392911 - protein, 9 aa, Homo Sapiens
VTKTITTPT

SEQ ID NO: 1392912 - protein, 9 aa, Homo Sapiens
ATMRTQTAA

SEQ ID NO: 1392913 - protein, 9 aa, Homo Sapiens
VLARHDIRR

SEQ ID NO: 1392914 - protein, 9 aa, Homo Sapiens
PGPAARGMG

SEQ ID NO: 1392915 - protein, 9 aa, Homo Sapiens
PLNVIDLME

SEQ ID NO: 1392916 - protein, 9 aa, Homo Sapiens
LSYQDPAGE

SEQ ID NO: 1392917 - protein, 9 aa, Homo Sapiens
PACLLGPVL

SEQ ID NO: 1392918 - protein, 9 aa, Homo Sapiens
GWSASCGPT

SEQ ID NO: 1392919 - protein, 9 aa, Homo Sapiens
PAARGMGGQ

SEQ ID NO: 1392920 - protein, 9 aa, Homo Sapiens
LRLRRPGNW

SEQ ID NO: 1392921 - protein, 9 aa, Homo Sapiens
ILLAYGESQ

SEQ ID NO: 1392922 - protein, 9 aa, Homo Sapiens
VLFMNIQED

SEQ ID NO: 1392923 - protein, 9 aa, Homo Sapiens
LCQAIEELY

SEQ ID NO: 1392924 - protein, 9 aa, Homo Sapiens
QKICSLLIL

SEQ ID NO: 1392925 - protein, 9 aa, Homo Sapiens
WHHWNQRGS

SEQ ID NO: 1392926 - protein, 9 aa, Homo Sapiens
EDKKIEEKD

SEQ ID NO: 1392927 - protein, 9 aa, Homo Sapiens
VPRHSSVLA

SEQ ID NO: 1392928 - protein, 9 aa, Homo Sapiens
VTFWEEGRI

SEQ ID NO: 1392929 - protein, 9 aa, Homo Sapiens
NSLVGLQIL

SEQ ID NO: 1392930 - protein, 9 aa, Homo Sapiens
HEAETLALV

SEQ ID NO: 1392931 - protein, 9 aa, Homo Sapiens
DPRLPAPHH

SEQ ID NO: 1392932 - protein, 9 aa, Homo Sapiens
RKQPQGPSC

SEQ ID NO: 1392933 - protein, 9 aa, Homo Sapiens
DGVRAPFTQ

SEQ ID NO: 1392934 - protein, 9 aa, Homo Sapiens
CSLYGKKLV

SEQ ID NO: 1392935 - protein, 9 aa, Homo Sapiens
CGYPGPAAR

SEQ ID NO: 1392936 - protein, 9 aa, Homo Sapiens
FSANIEDIS

SEQ ID NO: 1392937 - protein, 9 aa, Homo Sapiens
RGVGVLPAP

SEQ ID NO: 1392938 - protein, 9 aa, Homo Sapiens
TAPSAVPSV

SEQ ID NO: 1392939 - protein, 9 aa, Homo Sapiens
GWLQWRRVS

SEQ ID NO: 1392940 - protein, 9 aa, Homo Sapiens
YGDISLRVG

SEQ ID NO: 1392941 - protein, 9 aa, Homo Sapiens
SSPTGGGSV

SEQ ID NO: 1392942 - protein, 9 aa, Homo Sapiens
VQMVHFTVR

SEQ ID NO: 1392943 - protein, 9 aa, Homo Sapiens
WLERQEARL

SEQ ID NO: 1392944 - protein, 9 aa, Homo Sapiens
AGVGLAASF

SEQ ID NO: 1392945 - protein, 9 aa, Homo Sapiens
RSRGLPRAW

SEQ ID NO: 1392946 - protein, 9 aa, Homo Sapiens
EQDLQHPVD

SEQ ID NO: 1392947 - protein, 9 aa, Homo Sapiens
GFIHQASTA

SEQ ID NO: 1392948 - protein, 9 aa, Homo Sapiens
VQEAEVPAD

SEQ ID NO: 1392949 - protein, 9 aa, Homo Sapiens
HRPALLLLP

SEQ ID NO: 1392950 - protein, 9 aa, Homo Sapiens
QSITMGTAR

SEQ ID NO: 1392951 - protein, 9 aa, Homo Sapiens
HPDQREGDR

SEQ ID NO: 1392952 - protein, 9 aa, Homo Sapiens
AATSAQSLH

SEQ ID NO: 1392953 - protein, 9 aa, Homo Sapiens
GQPIIAALY

SEQ ID NO: 1392954 - protein, 9 aa, Homo Sapiens
TGCSLGSRL

SEQ ID NO: 1392955 - protein, 9 aa, Homo Sapiens
ATAWEPTWL

SEQ ID NO: 1392956 - protein, 9 aa, Homo Sapiens
ASKAAWIRK

SEQ ID NO: 1392957 - protein, 9 aa, Homo Sapiens
LSQSEDGVR

SEQ ID NO: 1392958 - protein, 9 aa, Homo Sapiens
PPVLERRGS

SEQ ID NO: 1392959 - protein, 9 aa, Homo Sapiens
LISAFSSKV

SEQ ID NO: 1392960 - protein, 9 aa, Homo Sapiens
HLLYTLGAV

SEQ ID NO: 1392961 - protein, 9 aa, Homo Sapiens
NGGMTPPKS

SEQ ID NO: 1392962 - protein, 9 aa, Homo Sapiens
NWTFLEHFL

SEQ ID NO: 1392963 - protein, 9 aa, Homo Sapiens
SAFSSKVVH

SEQ ID NO: 1392964 - protein, 9 aa, Homo Sapiens
MVNYFVSHT

SEQ ID NO: 1392965 - protein, 9 aa, Homo Sapiens
DERLCRSEA

SEQ ID NO: 1392966 - protein, 9 aa, Homo Sapiens
LGSTGCSLG

SEQ ID NO: 1392967 - protein, 9 aa, Homo Sapiens
AWDERLPSQ

SEQ ID NO: 1392968 - protein, 9 aa, Homo Sapiens
DPGKASKAA

SEQ ID NO: 1392969 - protein, 9 aa, Homo Sapiens
SRRNGSCRR

SEQ ID NO: 1392970 - protein, 9 aa, Homo Sapiens
AGDPGCQMC

SEQ ID NO: 1392971 - protein, 9 aa, Homo Sapiens
GIFELEHLP

SEQ ID NO: 1392972 - protein, 9 aa, Homo Sapiens
HDHPDQREG

SEQ ID NO: 1392973 - protein, 9 aa, Homo Sapiens
DVGSRPLLR

SEQ ID NO: 1392974 - protein, 9 aa, Homo Sapiens
TKGSVLWMS

SEQ ID NO: 1392975 - protein, 9 aa, Homo Sapiens
KPYRCRECD

SEQ ID NO: 1392976 - protein, 9 aa, Homo Sapiens
MSTLAEFVN

SEQ ID NO: 1392977 - protein, 9 aa, Homo Sapiens
ARAEPGGRP

SEQ ID NO: 1392978 - protein, 9 aa, Homo Sapiens
TGYQSIKRK

SEQ ID NO: 1392979 - protein, 9 aa, Homo Sapiens
WEKSFVDNF

SEQ ID NO: 1392980 - protein, 9 aa, Homo Sapiens
EILVRIGSG

SEQ ID NO: 1392981 - protein, 9 aa, Homo Sapiens
PMLSPSAFI

SEQ ID NO: 1392982 - protein, 9 aa, Homo Sapiens
TSLDAMVNY

SEQ ID NO: 1392983 - protein, 9 aa, Homo Sapiens
NLNTTCLFC

SEQ ID NO: 1392984 - protein, 9 aa, Homo Sapiens
VLFHVGSSF

SEQ ID NO: 1392985 - protein, 9 aa, Homo Sapiens
LCNVDLVLV

SEQ ID NO: 1392986 - protein, 9 aa, Homo Sapiens
VEIREVHEW

SEQ ID NO: 1392987 - protein, 9 aa, Homo Sapiens
PTSGSTPGS

SEQ ID NO: 1392988 - protein, 9 aa, Homo Sapiens
ISILGVASS

SEQ ID NO: 1392989 - protein, 9 aa, Homo Sapiens
EEQWGALYR

SEQ ID NO: 1392990 - protein, 9 aa, Homo Sapiens
VQQPEFHAL

SEQ ID NO: 1392991 - protein, 9 aa, Homo Sapiens
MDNTGQLVF

SEQ ID NO: 1392992 - protein, 9 aa, Homo Sapiens
DILEETWEK

SEQ ID NO: 1392993 - protein, 9 aa, Homo Sapiens
SCVPTAARP

SEQ ID NO: 1392994 - protein, 9 aa, Homo Sapiens
RARPGTCAA

SEQ ID NO: 1392995 - protein, 9 aa, Homo Sapiens
DHGCPSQLR

SEQ ID NO: 1392996 - protein, 9 aa, Homo Sapiens
RLDHFLTCS

SEQ ID NO: 1392997 - protein, 9 aa, Homo Sapiens
HTVSEFIKY

SEQ ID NO: 1392998 - protein, 9 aa, Homo Sapiens
EDGDPGDIG

SEQ ID NO: 1392999 - protein, 9 aa, Homo Sapiens
ERIITSRIL

SEQ ID NO: 1393000 - protein, 9 aa, Homo Sapiens
LVPLPLCGY

SEQ ID NO: 1393001 - protein, 9 aa, Homo Sapiens
FPLLITSSL

SEQ ID NO: 1393002 - protein, 9 aa, Homo Sapiens
IPTTEGVSP

SEQ ID NO: 1393003 - protein, 9 aa, Homo Sapiens
DLDVGDCPK

SEQ ID NO: 1393004 - protein, 9 aa, Homo Sapiens
NHSKCITEC

SEQ ID NO: 1393005 - protein, 9 aa, Homo Sapiens
LGSARRSRR

SEQ ID NO: 1393006 - protein, 9 aa, Homo Sapiens
ISVKDHRTS

SEQ ID NO: 1393007 - protein, 9 aa, Homo Sapiens
GHTGCFPCG

SEQ ID NO: 1393008 - protein, 9 aa, Homo Sapiens
TGVKPNECS

SEQ ID NO: 1393009 - protein, 9 aa, Homo Sapiens
KATPELRSS

SEQ ID NO: 1393010 - protein, 9 aa, Homo Sapiens
LLLSQYPWK

SEQ ID NO: 1393011 - protein, 9 aa, Homo Sapiens
FIHQASTAS

SEQ ID NO: 1393012 - protein, 9 aa, Homo Sapiens
HEDCCLRLK

SEQ ID NO: 1393013 - protein, 9 aa, Homo Sapiens
AAIKRQKYE

SEQ ID NO: 1393014 - protein, 9 aa, Homo Sapiens
WTPRPHGLQ

SEQ ID NO: 1393015 - protein, 9 aa, Homo Sapiens
AATIAPVEC

SEQ ID NO: 1393016 - protein, 9 aa, Homo Sapiens
SAEQSPVVG

SEQ ID NO: 1393017 - protein, 9 aa, Homo Sapiens
WRRTGASTP

SEQ ID NO: 1393018 - protein, 9 aa, Homo Sapiens
LRRAANHDV

SEQ ID NO: 1393019 - protein, 9 aa, Homo Sapiens
TVMSLGEDL

SEQ ID NO: 1393020 - protein, 9 aa, Homo Sapiens
DARPPAEEE

SEQ ID NO: 1393021 - protein, 9 aa, Homo Sapiens
AIRGEEAAL

SEQ ID NO: 1393022 - protein, 9 aa, Homo Sapiens
FSIYFCQGD

SEQ ID NO: 1393023 - protein, 9 aa, Homo Sapiens
ASVGGSLGQ

SEQ ID NO: 1393024 - protein, 9 aa, Homo Sapiens
DFRPLEKCY

SEQ ID NO: 1393025 - protein, 9 aa, Homo Sapiens
SPRRSPALR

SEQ ID NO: 1393026 - protein, 9 aa, Homo Sapiens
LATVSQDHT

SEQ ID NO: 1393027 - protein, 9 aa, Homo Sapiens
GTSPSQGIL

SEQ ID NO: 1393028 - protein, 9 aa, Homo Sapiens
KDENAVLIR

SEQ ID NO: 1393029 - protein, 9 aa, Homo Sapiens
PATLCLLQH

SEQ ID NO: 1393030 - protein, 9 aa, Homo Sapiens
KKTSRSQPG

SEQ ID NO: 1393031 - protein, 9 aa, Homo Sapiens
YYTEFLFLG

SEQ ID NO: 1393032 - protein, 9 aa, Homo Sapiens
VKDHRTSQN

SEQ ID NO: 1393033 - protein, 9 aa, Homo Sapiens
HKKQSQSRP

SEQ ID NO: 1393034 - protein, 9 aa, Homo Sapiens
WRLDSSAPR

SEQ ID NO: 1393035 - protein, 9 aa, Homo Sapiens
AALDLSPLY

SEQ ID NO: 1393036 - protein, 9 aa, Homo Sapiens
RQDWQNLVT

SEQ ID NO: 1393037 - protein, 9 aa, Homo Sapiens
PRAAPAPPT

SEQ ID NO: 1393038 - protein, 9 aa, Homo Sapiens
FLISAFSSK

SEQ ID NO: 1393039 - protein, 9 aa, Homo Sapiens
TSPPPGYPS

SEQ ID NO: 1393040 - protein, 9 aa, Homo Sapiens
PPDRDPMLS

SEQ ID NO: 1393041 - protein, 9 aa, Homo Sapiens
RPLRPLLQL

SEQ ID NO: 1393042 - protein, 9 aa, Homo Sapiens
EKPSALDYK

SEQ ID NO: 1393043 - protein, 9 aa, Homo Sapiens
REPGRPLRP

SEQ ID NO: 1393044 - protein, 9 aa, Homo Sapiens
ESSQSTAPS

SEQ ID NO: 1393045 - protein, 9 aa, Homo Sapiens
FMGIFELEH

SEQ ID NO: 1393046 - protein, 9 aa, Homo Sapiens
SFGATSPVT

SEQ ID NO: 1393047 - protein, 9 aa, Homo Sapiens
VSQDHTVRI

SEQ ID NO: 1393048 - protein, 9 aa, Homo Sapiens
GMLTVIGQG

SEQ ID NO: 1393049 - protein, 9 aa, Homo Sapiens
ATSSQDMID

SEQ ID NO: 1393050 - protein, 9 aa, Homo Sapiens
VGVQTVQQH

SEQ ID NO: 1393051 - protein, 9 aa, Homo Sapiens
IHQHEDCCL

SEQ ID NO: 1393052 - protein, 9 aa, Homo Sapiens
SAACRWPSL

SEQ ID NO: 1393053 - protein, 9 aa, Homo Sapiens
GWKDLPATL

SEQ ID NO: 1393054 - protein, 9 aa, Homo Sapiens
PCGPARSAR

SEQ ID NO: 1393055 - protein, 9 aa, Homo Sapiens
SRKTWQRRL

SEQ ID NO: 1393056 - protein, 9 aa, Homo Sapiens
MLYFYAEQG

SEQ ID NO: 1393057 - protein, 9 aa, Homo Sapiens
CRRPRGGLV

SEQ ID NO: 1393058 - protein, 9 aa, Homo Sapiens
AKYRTAHAM

SEQ ID NO: 1393059 - protein, 9 aa, Homo Sapiens
GSYIIMVLF

SEQ ID NO: 1393060 - protein, 9 aa, Homo Sapiens
GKHIILFLF

SEQ ID NO: 1393061 - protein, 9 aa, Homo Sapiens
GRRLLLPRL

SEQ ID NO: 1393062 - protein, 9 aa, Homo Sapiens
AMDVMCYTA

SEQ ID NO: 1393063 - protein, 9 aa, Homo Sapiens
PALLLLPPL

SEQ ID NO: 1393064 - protein, 9 aa, Homo Sapiens
FQNHRVKHK

SEQ ID NO: 1393065 - protein, 9 aa, Homo Sapiens
LRAYPIQVL

SEQ ID NO: 1393066 - protein, 9 aa, Homo Sapiens
HTDVIHSVC

SEQ ID NO: 1393067 - protein, 9 aa, Homo Sapiens
PCWLLQFFS

SEQ ID NO: 1393068 - protein, 9 aa, Homo Sapiens
TISFCIVLC

SEQ ID NO: 1393069 - protein, 9 aa, Homo Sapiens
YFLEIASTY

SEQ ID NO: 1393070 - protein, 9 aa, Homo Sapiens
PELTVVTRV

SEQ ID NO: 1393071 - protein, 9 aa, Homo Sapiens
QMCAACGPG

SEQ ID NO: 1393072 - protein, 9 aa, Homo Sapiens
ELVPILEIP

SEQ ID NO: 1393073 - protein, 9 aa, Homo Sapiens
QTMNRICVL

SEQ ID NO: 1393074 - protein, 9 aa, Homo Sapiens
NDNEKETMQ

SEQ ID NO: 1393075 - protein, 9 aa, Homo Sapiens
VAAAAILRV

SEQ ID NO: 1393076 - protein, 9 aa, Homo Sapiens
GSTPGSGPS

SEQ ID NO: 1393077 - protein, 9 aa, Homo Sapiens
TNPSMRAVR

SEQ ID NO: 1393078 - protein, 9 aa, Homo Sapiens
QTIHQLATS

SEQ ID NO: 1393079 - protein, 9 aa, Homo Sapiens
YMQAVWQDP

SEQ ID NO: 1393080 - protein, 9 aa, Homo Sapiens
DAREREHIH

SEQ ID NO: 1393081 - protein, 9 aa, Homo Sapiens
SPGSLPKSS

SEQ ID NO: 1393082 - protein, 9 aa, Homo Sapiens
HGRLVIVGH

SEQ ID NO: 1393083 - protein, 9 aa, Homo Sapiens
LFLIIQTTG

SEQ ID NO: 1393084 - protein, 9 aa, Homo Sapiens
NPAVTATSA

SEQ ID NO: 1393085 - protein, 9 aa, Homo Sapiens
DLQHPVDDA

SEQ ID NO: 1393086 - protein, 9 aa, Homo Sapiens
GPTSGSTPG

SEQ ID NO: 1393087 - protein, 9 aa, Homo Sapiens
SGDWWGPSR

SEQ ID NO: 1393088 - protein, 9 aa, Homo Sapiens
MLSERSALQ

SEQ ID NO: 1393089 - protein, 9 aa, Homo Sapiens
NAALPTANG

SEQ ID NO: 1393090 - protein, 9 aa, Homo Sapiens
GTGGSTGDV

SEQ ID NO: 1393091 - protein, 9 aa, Homo Sapiens
DHFLTCSFK

SEQ ID NO: 1393092 - protein, 9 aa, Homo Sapiens
LPVWPALLG

SEQ ID NO: 1393093 - protein, 9 aa, Homo Sapiens
TAGSTASVG

SEQ ID NO: 1393094 - protein, 9 aa, Homo Sapiens
QFMYHHSRP

SEQ ID NO: 1393095 - protein, 9 aa, Homo Sapiens
AQGSGGDTR

SEQ ID NO: 1393096 - protein, 9 aa, Homo Sapiens
PAKLGSARR

SEQ ID NO: 1393097 - protein, 9 aa, Homo Sapiens
VQAGDGHGR

SEQ ID NO: 1393098 - protein, 9 aa, Homo Sapiens
NLPLCSHFS

SEQ ID NO: 1393099 - protein, 9 aa, Homo Sapiens
IRVQAQVYF

SEQ ID NO: 1393100 - protein, 9 aa, Homo Sapiens
TSRVQKNLP

SEQ ID NO: 1393101 - protein, 9 aa, Homo Sapiens
MQGTRNVIE

SEQ ID NO: 1393102 - protein, 9 aa, Homo Sapiens
GNHYMEMVK

SEQ ID NO: 1393103 - protein, 9 aa, Homo Sapiens
GYSGSGSGC

SEQ ID NO: 1393104 - protein, 9 aa, Homo Sapiens
FDGKDGLMA

SEQ ID NO: 1393105 - protein, 9 aa, Homo Sapiens
CPGHVSVML

SEQ ID NO: 1393106 - protein, 9 aa, Homo Sapiens
DKKIEEKDP

SEQ ID NO: 1393107 - protein, 9 aa, Homo Sapiens
SPTGGGSVP

SEQ ID NO: 1393108 - protein, 9 aa, Homo Sapiens
WGALYRLSV

SEQ ID NO: 1393109 - protein, 9 aa, Homo Sapiens
HFYWHCGSA

SEQ ID NO: 1393110 - protein, 9 aa, Homo Sapiens
EQQILSTYQ

SEQ ID NO: 1393111 - protein, 9 aa, Homo Sapiens
ANHDVGSEL

SEQ ID NO: 1393112 - protein, 9 aa, Homo Sapiens
FESTVEKLQ

SEQ ID NO: 1393113 - protein, 9 aa, Homo Sapiens
DPSLQQTLR

SEQ ID NO: 1393114 - protein, 9 aa, Homo Sapiens
TPGYIFGKH

SEQ ID NO: 1393115 - protein, 9 aa, Homo Sapiens
NFNPDHIRV

SEQ ID NO: 1393116 - protein, 9 aa, Homo Sapiens
SVEKTSKRD

SEQ ID NO: 1393117 - protein, 9 aa, Homo Sapiens
PDKENPGAI

SEQ ID NO: 1393118 - protein, 9 aa, Homo Sapiens
MPSSCTATA

SEQ ID NO: 1393119 - protein, 9 aa, Homo Sapiens
RRLRRAANH

SEQ ID NO: 1393120 - protein, 9 aa, Homo Sapiens
TWLLSGRVA

SEQ ID NO: 1393121 - protein, 9 aa, Homo Sapiens
IHTKLEEAL

SEQ ID NO: 1393122 - protein, 9 aa, Homo Sapiens
NTYISLILG

SEQ ID NO: 1393123 - protein, 9 aa, Homo Sapiens
EETPSSEPK

SEQ ID NO: 1393124 - protein, 9 aa, Homo Sapiens
INPRTPPKI

SEQ ID NO: 1393125 - protein, 9 aa, Homo Sapiens
ALGSRGGTN

SEQ ID NO: 1393126 - protein, 9 aa, Homo Sapiens
VGPVDAGRY

SEQ ID NO: 1393127 - protein, 9 aa, Homo Sapiens
AAKLYDIAK

SEQ ID NO: 1393128 - protein, 9 aa, Homo Sapiens
EGCISVKDH

SEQ ID NO: 1393129 - protein, 9 aa, Homo Sapiens
FGATSPVTW

SEQ ID NO: 1393130 - protein, 9 aa, Homo Sapiens
YYLVTFWEE

SEQ ID NO: 1393131 - protein, 9 aa, Homo Sapiens
YQDSTFEEN

SEQ ID NO: 1393132 - protein, 9 aa, Homo Sapiens
GKASKAAWI

SEQ ID NO: 1393133 - protein, 9 aa, Homo Sapiens
SISILGVAS

SEQ ID NO: 1393134 - protein, 9 aa, Homo Sapiens
SEHACTALQ

SEQ ID NO: 1393135 - protein, 9 aa, Homo Sapiens
NVNMESSRN

SEQ ID NO: 1393136 - protein, 9 aa, Homo Sapiens
SSPRRSPAL

SEQ ID NO: 1393137 - protein, 9 aa, Homo Sapiens
WRPTAIRQT

SEQ ID NO: 1393138 - protein, 9 aa, Homo Sapiens
FCGREYVQA

SEQ ID NO: 1393139 - protein, 9 aa, Homo Sapiens
FFCLRGHPS

SEQ ID NO: 1393140 - protein, 9 aa, Homo Sapiens
HSKCITECV

SEQ ID NO: 1393141 - protein, 9 aa, Homo Sapiens
IWEVMPRTL

SEQ ID NO: 1393142 - protein, 9 aa, Homo Sapiens
DLKIYLQTT

SEQ ID NO: 1393143 - protein, 9 aa, Homo Sapiens
NRVCSLQFD

SEQ ID NO: 1393144 - protein, 9 aa, Homo Sapiens
LARHDIRRE

SEQ ID NO: 1393145 - protein, 9 aa, Homo Sapiens
SMPEQVHKV

SEQ ID NO: 1393146 - protein, 9 aa, Homo Sapiens
WRAWWQENL

SEQ ID NO: 1393147 - protein, 9 aa, Homo Sapiens
PAPVPVLSS

SEQ ID NO: 1393148 - protein, 9 aa, Homo Sapiens
KGKEHVNPE

SEQ ID NO: 1393149 - protein, 9 aa, Homo Sapiens
PEYMFNSNS

SEQ ID NO: 1393150 - protein, 9 aa, Homo Sapiens
HISSARQLS

SEQ ID NO: 1393151 - protein, 9 aa, Homo Sapiens
NTGELMAMK

SEQ ID NO: 1393152 - protein, 9 aa, Homo Sapiens
NPGAIEASV

SEQ ID NO: 1393153 - protein, 9 aa, Homo Sapiens
PTAIPSDET

SEQ ID NO: 1393154 - protein, 9 aa, Homo Sapiens
AVICDSCTV

SEQ ID NO: 1393155 - protein, 9 aa, Homo Sapiens
RMTTNTYIS

SEQ ID NO: 1393156 - protein, 9 aa, Homo Sapiens
EFSSPILNA

SEQ ID NO: 1393157 - protein, 9 aa, Homo Sapiens
SPKPKAQTM

SEQ ID NO: 1393158 - protein, 9 aa, Homo Sapiens
GFFVLYYGQ

SEQ ID NO: 1393159 - protein, 9 aa, Homo Sapiens
RVAVVPLGT

SEQ ID NO: 1393160 - protein, 9 aa, Homo Sapiens
IYECKTCGT

SEQ ID NO: 1393161 - protein, 9 aa, Homo Sapiens
LIQRELLKT

SEQ ID NO: 1393162 - protein, 9 aa, Homo Sapiens
RVTVLLLLP

SEQ ID NO: 1393163 - protein, 9 aa, Homo Sapiens
IIGSPSVAR

SEQ ID NO: 1393164 - protein, 9 aa, Homo Sapiens
YSCGSGLGI

SEQ ID NO: 1393165 - protein, 9 aa, Homo Sapiens
NKKVVEEEK

SEQ ID NO: 1393166 - protein, 9 aa, Homo Sapiens
WKYTTESSD

SEQ ID NO: 1393167 - protein, 9 aa, Homo Sapiens
KDDYFAKKK

SEQ ID NO: 1393168 - protein, 9 aa, Homo Sapiens
LIMISALVA

SEQ ID NO: 1393169 - protein, 9 aa, Homo Sapiens
GHAQPEAAQ

SEQ ID NO: 1393170 - protein, 9 aa, Homo Sapiens
SQRAVRGTS

SEQ ID NO: 1393171 - protein, 9 aa, Homo Sapiens
QDKRVLVIG

SEQ ID NO: 1393172 - protein, 9 aa, Homo Sapiens
AGQAGHHSQ

SEQ ID NO: 1393173 - protein, 9 aa, Homo Sapiens
TILYSGGRS

SEQ ID NO: 1393174 - protein, 9 aa, Homo Sapiens
AQLYKGIED

SEQ ID NO: 1393175 - protein, 9 aa, Homo Sapiens
HACGGAGGG

SEQ ID NO: 1393176 - protein, 9 aa, Homo Sapiens
PPAATSAQS

SEQ ID NO: 1393177 - protein, 9 aa, Homo Sapiens
PLLQLRWPG

SEQ ID NO: 1393178 - protein, 9 aa, Homo Sapiens
VQLSEDEED

SEQ ID NO: 1393179 - protein, 9 aa, Homo Sapiens
GCPFIETSA

SEQ ID NO: 1393180 - protein, 9 aa, Homo Sapiens
RGALTTRPS

SEQ ID NO: 1393181 - protein, 9 aa, Homo Sapiens
MRTQTAATL

SEQ ID NO: 1393182 - protein, 9 aa, Homo Sapiens
SWRAGSSGN

SEQ ID NO: 1393183 - protein, 9 aa, Homo Sapiens
NTESSRQTL

SEQ ID NO: 1393184 - protein, 9 aa, Homo Sapiens
SARSPTSSP

SEQ ID NO: 1393185 - protein, 9 aa, Homo Sapiens
LKICACINS

SEQ ID NO: 1393186 - protein, 9 aa, Homo Sapiens
TIHQLATSS

SEQ ID NO: 1393187 - protein, 9 aa, Homo Sapiens
NTSYRSLLC

SEQ ID NO: 1393188 - protein, 9 aa, Homo Sapiens
PVKCGRVEG

SEQ ID NO: 1393189 - protein, 9 aa, Homo Sapiens
RKEAFTEAW

SEQ ID NO: 1393190 - protein, 9 aa, Homo Sapiens
QAVQTMNRI

SEQ ID NO: 1393191 - protein, 9 aa, Homo Sapiens
LQKQVETQS

SEQ ID NO: 1393192 - protein, 9 aa, Homo Sapiens
STYQMTPQS

SEQ ID NO: 1393193 - protein, 9 aa, Homo Sapiens
YNFSDGLAI

SEQ ID NO: 1393194 - protein, 9 aa, Homo Sapiens
LLEVKLKSV

SEQ ID NO: 1393195 - protein, 9 aa, Homo Sapiens
GGTNGGSSG

SEQ ID NO: 1393196 - protein, 9 aa, Homo Sapiens
SAPTMAAAP

SEQ ID NO: 1393197 - protein, 9 aa, Homo Sapiens
CTSWVPRDG

SEQ ID NO: 1393198 - protein, 9 aa, Homo Sapiens
GSLPKSSPL

SEQ ID NO: 1393199 - protein, 9 aa, Homo Sapiens
PYYLPNLTH

SEQ ID NO: 1393200 - protein, 9 aa, Homo Sapiens
SPLKRDPQQ

SEQ ID NO: 1393201 - protein, 9 aa, Homo Sapiens
RRECRIEIE

SEQ ID NO: 1393202 - protein, 9 aa, Homo Sapiens
DYEEMKNLN

SEQ ID NO: 1393203 - protein, 9 aa, Homo Sapiens
VTAASVFYT

SEQ ID NO: 1393204 - protein, 9 aa, Homo Sapiens
RNGSCRRWR

SEQ ID NO: 1393205 - protein, 9 aa, Homo Sapiens
PRHSSVLAT

SEQ ID NO: 1393206 - protein, 9 aa, Homo Sapiens
GAETRKESR

SEQ ID NO: 1393207 - protein, 9 aa, Homo Sapiens
QTRYAQSRM

SEQ ID NO: 1393208 - protein, 9 aa, Homo Sapiens
PRPCWSRCS

SEQ ID NO: 1393209 - protein, 9 aa, Homo Sapiens
GDSDVSLHC

SEQ ID NO: 1393210 - protein, 9 aa, Homo Sapiens
SSASSKEDL

SEQ ID NO: 1393211 - protein, 9 aa, Homo Sapiens
NFSVIVANK

SEQ ID NO: 1393212 - protein, 9 aa, Homo Sapiens
PTARATSGT

SEQ ID NO: 1393213 - protein, 9 aa, Homo Sapiens
YECKTCGTM

SEQ ID NO: 1393214 - protein, 9 aa, Homo Sapiens
KGKDSATDS

SEQ ID NO: 1393215 - protein, 9 aa, Homo Sapiens
IDLMEPTLQ

SEQ ID NO: 1393216 - protein, 9 aa, Homo Sapiens
SQQLRKPRR

SEQ ID NO: 1393217 - protein, 9 aa, Homo Sapiens
AKSHCLDHI

SEQ ID NO: 1393218 - protein, 9 aa, Homo Sapiens
VQQHGRRLL

SEQ ID NO: 1393219 - protein, 9 aa, Homo Sapiens
APHGYTCDY

SEQ ID NO: 1393220 - protein, 9 aa, Homo Sapiens
HHSGDWWGP

SEQ ID NO: 1393221 - protein, 9 aa, Homo Sapiens
EKKKKKTSR

SEQ ID NO: 1393222 - protein, 9 aa, Homo Sapiens
MDRYKIDSL

SEQ ID NO: 1393223 - protein, 9 aa, Homo Sapiens
RRRTWWRTR

SEQ ID NO: 1393224 - protein, 9 aa, Homo Sapiens
SVLWMSPAS

SEQ ID NO: 1393225 - protein, 9 aa, Homo Sapiens
PPLPNKPPL

SEQ ID NO: 1393226 - protein, 9 aa, Homo Sapiens
PAQPALRPP

SEQ ID NO: 1393227 - protein, 9 aa, Homo Sapiens
IVCDYILPV

SEQ ID NO: 1393228 - protein, 9 aa, Homo Sapiens
ASLWGPQTI

SEQ ID NO: 1393229 - protein, 9 aa, Homo Sapiens
DFGTTCDIQ

SEQ ID NO: 1393230 - protein, 9 aa, Homo Sapiens
STAPSPSVL

SEQ ID NO: 1393231 - protein, 9 aa, Homo Sapiens
KTGWSTRGR

SEQ ID NO: 1393232 - protein, 9 aa, Homo Sapiens
DAGALSQDA

SEQ ID NO: 1393233 - protein, 9 aa, Homo Sapiens
QSGCGQHPG

SEQ ID NO: 1393234 - protein, 9 aa, Homo Sapiens
SESHSHWVL

SEQ ID NO: 1393235 - protein, 9 aa, Homo Sapiens
RDPSLQQTL

SEQ ID NO: 1393236 - protein, 9 aa, Homo Sapiens
SDVGWGDNC

SEQ ID NO: 1393237 - protein, 9 aa, Homo Sapiens
GILVDTSGL

SEQ ID NO: 1393238 - protein, 9 aa, Homo Sapiens
EQVHKVCVK

SEQ ID NO: 1393239 - protein, 9 aa, Homo Sapiens
DAMVNYFVS

SEQ ID NO: 1393240 - protein, 9 aa, Homo Sapiens
LMHLRGDIN

SEQ ID NO: 1393241 - protein, 9 aa, Homo Sapiens
KGYELVPIL

SEQ ID NO: 1393242 - protein, 9 aa, Homo Sapiens
PSMPSSCTA

SEQ ID NO: 1393243 - protein, 9 aa, Homo Sapiens
PTRIAWQSI

SEQ ID NO: 1393244 - protein, 9 aa, Homo Sapiens
PTCPLGSEG

SEQ ID NO: 1393245 - protein, 9 aa, Homo Sapiens
VWAGLSAQL

SEQ ID NO: 1393246 - protein, 9 aa, Homo Sapiens
VPTSLPMTQ

SEQ ID NO: 1393247 - protein, 9 aa, Homo Sapiens
PVTTSRCCP

SEQ ID NO: 1393248 - protein, 9 aa, Homo Sapiens
TPSQHFTGP

SEQ ID NO: 1393249 - protein, 9 aa, Homo Sapiens
LVEEMLGLA

SEQ ID NO: 1393250 - protein, 9 aa, Homo Sapiens
RGPVRLLLG

SEQ ID NO: 1393251 - protein, 9 aa, Homo Sapiens
TVDYHRLDQ

SEQ ID NO: 1393252 - protein, 9 aa, Homo Sapiens
TFEENMHVR

SEQ ID NO: 1393253 - protein, 9 aa, Homo Sapiens
GVRAPFTQA

SEQ ID NO: 1393254 - protein, 9 aa, Homo Sapiens
WFQNHRVKH

SEQ ID NO: 1393255 - protein, 9 aa, Homo Sapiens
TARATSGTA

SEQ ID NO: 1393256 - protein, 9 aa, Homo Sapiens
LPLCGYPGP

SEQ ID NO: 1393257 - protein, 9 aa, Homo Sapiens
SCGVTGLKL

SEQ ID NO: 1393258 - protein, 9 aa, Homo Sapiens
AKNLRVDAG

SEQ ID NO: 1393259 - protein, 9 aa, Homo Sapiens
DDVCDFIDN

SEQ ID NO: 1393260 - protein, 9 aa, Homo Sapiens
SLGGHRLCV

SEQ ID NO: 1393261 - protein, 9 aa, Homo Sapiens
SKYTDRALQ

SEQ ID NO: 1393262 - protein, 9 aa, Homo Sapiens
AASRSWAWT

SEQ ID NO: 1393263 - protein, 9 aa, Homo Sapiens
RPSRDSLGA

SEQ ID NO: 1393264 - protein, 9 aa, Homo Sapiens
TEEQMSVIW

SEQ ID NO: 1393265 - protein, 9 aa, Homo Sapiens
FGTRASSNP

SEQ ID NO: 1393266 - protein, 9 aa, Homo Sapiens
QASTASDHG

SEQ ID NO: 1393267 - protein, 9 aa, Homo Sapiens
GGSLGQGLL

SEQ ID NO: 1393268 - protein, 9 aa, Homo Sapiens
GSPGPRMGP

SEQ ID NO: 1393269 - protein, 9 aa, Homo Sapiens
NSHPPTTTT

SEQ ID NO: 1393270 - protein, 9 aa, Homo Sapiens
IRGSWMGAR

SEQ ID NO: 1393271 - protein, 9 aa, Homo Sapiens
GRGAPRHPH

SEQ ID NO: 1393272 - protein, 9 aa, Homo Sapiens
KPSARSPTW

SEQ ID NO: 1393273 - protein, 9 aa, Homo Sapiens
VIEDFLRNF

SEQ ID NO: 1393274 - protein, 9 aa, Homo Sapiens
SPAPSAGRT

SEQ ID NO: 1393275 - protein, 9 aa, Homo Sapiens
LEASWQPAC

SEQ ID NO: 1393276 - protein, 9 aa, Homo Sapiens
DNGGHPEPL

SEQ ID NO: 1393277 - protein, 9 aa, Homo Sapiens
AASARSPTS

SEQ ID NO: 1393278 - protein, 9 aa, Homo Sapiens
PMGVVQNEP

SEQ ID NO: 1393279 - protein, 9 aa, Homo Sapiens
SAPTGAEAD

SEQ ID NO: 1393280 - protein, 9 aa, Homo Sapiens
DSSAPRHHP

SEQ ID NO: 1393281 - protein, 9 aa, Homo Sapiens
FQQMSSWAT

SEQ ID NO: 1393282 - protein, 9 aa, Homo Sapiens
ILNLVAAGF

SEQ ID NO: 1393283 - protein, 9 aa, Homo Sapiens
GADSNPRRC

SEQ ID NO: 1393284 - protein, 9 aa, Homo Sapiens
PVQEAEVPA

SEQ ID NO: 1393285 - protein, 9 aa, Homo Sapiens
RLSSLPCFL

SEQ ID NO: 1393286 - protein, 9 aa, Homo Sapiens
PNSLVGLQI

SEQ ID NO: 1393287 - protein, 9 aa, Homo Sapiens
SRMHWRAWW

SEQ ID NO: 1393288 - protein, 9 aa, Homo Sapiens
PLSDSPPLQ

SEQ ID NO: 1393289 - protein, 9 aa, Homo Sapiens
CLALGSRGG

SEQ ID NO: 1393290 - protein, 9 aa, Homo Sapiens
HIRVQAQVY

SEQ ID NO: 1393291 - protein, 9 aa, Homo Sapiens
MTNVQIATK

SEQ ID NO: 1393292 - protein, 9 aa, Homo Sapiens
KSEKLDPQP

SEQ ID NO: 1393293 - protein, 9 aa, Homo Sapiens
DKQTCTLFS

SEQ ID NO: 1393294 - protein, 9 aa, Homo Sapiens
GLVPLPLCG

SEQ ID NO: 1393295 - protein, 9 aa, Homo Sapiens
VRISPMSHI

SEQ ID NO: 1393296 - protein, 9 aa, Homo Sapiens
PQDVCQGSP

SEQ ID NO: 1393297 - protein, 9 aa, Homo Sapiens
YTASIMTLC

SEQ ID NO: 1393298 - protein, 9 aa, Homo Sapiens
PTPPRSSPK

SEQ ID NO: 1393299 - protein, 9 aa, Homo Sapiens
PKAQTMNSF

SEQ ID NO: 1393300 - protein, 9 aa, Homo Sapiens
NTHTYFYTR

SEQ ID NO: 1393301 - protein, 9 aa, Homo Sapiens
REEGYYYRE

SEQ ID NO: 1393302 - protein, 9 aa, Homo Sapiens
ILPDDVCDF

SEQ ID NO: 1393303 - protein, 9 aa, Homo Sapiens
FCLLPQQRF

SEQ ID NO: 1393304 - protein, 9 aa, Homo Sapiens
YGHGVGRIW

SEQ ID NO: 1393305 - protein, 9 aa, Homo Sapiens
RGFVLMGSS

SEQ ID NO: 1393306 - protein, 9 aa, Homo Sapiens
QQPEFHALR

SEQ ID NO: 1393307 - protein, 9 aa, Homo Sapiens
CLEPPDTSQ

SEQ ID NO: 1393308 - protein, 9 aa, Homo Sapiens
LFSWHTPLA

SEQ ID NO: 1393309 - protein, 9 aa, Homo Sapiens
RCATLEPQN

SEQ ID NO: 1393310 - protein, 9 aa, Homo Sapiens
LGFFVLYYG

SEQ ID NO: 1393311 - protein, 9 aa, Homo Sapiens
RSKKVSTRK

SEQ ID NO: 1393312 - protein, 9 aa, Homo Sapiens
GASTPARSP

SEQ ID NO: 1393313 - protein, 9 aa, Homo Sapiens
KPSKRRWSR

SEQ ID NO: 1393314 - protein, 9 aa, Homo Sapiens
APTMAAAPH

SEQ ID NO: 1393315 - protein, 9 aa, Homo Sapiens
AEPGGRPWC

SEQ ID NO: 1393316 - protein, 9 aa, Homo Sapiens
PAPPPELTV

SEQ ID NO: 1393317 - protein, 9 aa, Homo Sapiens
SPSSLPQDV

SEQ ID NO: 1393318 - protein, 9 aa, Homo Sapiens
KNLRVDAGD

SEQ ID NO: 1393319 - protein, 9 aa, Homo Sapiens
SPPSAPASK

SEQ ID NO: 1393320 - protein, 9 aa, Homo Sapiens
KAREEGYYY

SEQ ID NO: 1393321 - protein, 9 aa, Homo Sapiens
GGLAGAMNS

SEQ ID NO: 1393322 - protein, 9 aa, Homo Sapiens
IMSTTGWLE

SEQ ID NO: 1393323 - protein, 9 aa, Homo Sapiens
VFVGNFLHV

SEQ ID NO: 1393324 - protein, 9 aa, Homo Sapiens
YDIAKNADK

SEQ ID NO: 1393325 - protein, 9 aa, Homo Sapiens
RPGTCAARS

SEQ ID NO: 1393326 - protein, 9 aa, Homo Sapiens
GQHPGDGDA

SEQ ID NO: 1393327 - protein, 9 aa, Homo Sapiens
ICCPHSREK

SEQ ID NO: 1393328 - protein, 9 aa, Homo Sapiens
GAGSYIIMV

SEQ ID NO: 1393329 - protein, 9 aa, Homo Sapiens
CSRGSQRAV

SEQ ID NO: 1393330 - protein, 9 aa, Homo Sapiens
PVEAAIHTK

SEQ ID NO: 1393331 - protein, 9 aa, Homo Sapiens
PRESSWLSR

SEQ ID NO: 1393332 - protein, 9 aa, Homo Sapiens
CKYYSTTHG

SEQ ID NO: 1393333 - protein, 9 aa, Homo Sapiens
PNGLLGAQA

SEQ ID NO: 1393334 - protein, 9 aa, Homo Sapiens
VQSLHQELY

SEQ ID NO: 1393335 - protein, 9 aa, Homo Sapiens
ILNAEELNI

SEQ ID NO: 1393336 - protein, 9 aa, Homo Sapiens
DIGGSGRGS

SEQ ID NO: 1393337 - protein, 9 aa, Homo Sapiens
SQGSLFVEN

SEQ ID NO: 1393338 - protein, 9 aa, Homo Sapiens
KVATDLQLS

SEQ ID NO: 1393339 - protein, 9 aa, Homo Sapiens
TLLENGTRV

SEQ ID NO: 1393340 - protein, 9 aa, Homo Sapiens
PLASPPAWD

SEQ ID NO: 1393341 - protein, 9 aa, Homo Sapiens
VNKGQPIIA

SEQ ID NO: 1393342 - protein, 9 aa, Homo Sapiens
KVDYGDISL

SEQ ID NO: 1393343 - protein, 9 aa, Homo Sapiens
VSARGPVRL

SEQ ID NO: 1393344 - protein, 9 aa, Homo Sapiens
RDGKIIVGD

SEQ ID NO: 1393345 - protein, 9 aa, Homo Sapiens
STPGSGPSP

SEQ ID NO: 1393346 - protein, 9 aa, Homo Sapiens
VVQNEPAQR

SEQ ID NO: 1393347 - protein, 9 aa, Homo Sapiens
MHVKQEEKL

SEQ ID NO: 1393348 - protein, 9 aa, Homo Sapiens
TSCLKFLSP

SEQ ID NO: 1393349 - protein, 9 aa, Homo Sapiens
TTLECIASV

SEQ ID NO: 1393350 - protein, 9 aa, Homo Sapiens
NLIPCGPAR

SEQ ID NO: 1393351 - protein, 9 aa, Homo Sapiens
MEMVKNLRM

SEQ ID NO: 1393352 - protein, 9 aa, Homo Sapiens
SLAFSVTTW

SEQ ID NO: 1393353 - protein, 9 aa, Homo Sapiens
ILSQLHHSM

SEQ ID NO: 1393354 - protein, 9 aa, Homo Sapiens
WLERAYGRL

SEQ ID NO: 1393355 - protein, 9 aa, Homo Sapiens
LEVDNGAAQ

SEQ ID NO: 1393356 - protein, 9 aa, Homo Sapiens
AQRLLEVIA

SEQ ID NO: 1393357 - protein, 9 aa, Homo Sapiens
LEPCTPVPR

SEQ ID NO: 1393358 - protein, 9 aa, Homo Sapiens
AARGMGGQP

SEQ ID NO: 1393359 - protein, 9 aa, Homo Sapiens
HAKNLRVDA

SEQ ID NO: 1393360 - protein, 9 aa, Homo Sapiens
VPTILYSGG

SEQ ID NO: 1393361 - protein, 9 aa, Homo Sapiens
QKNLPLCSH

SEQ ID NO: 1393362 - protein, 9 aa, Homo Sapiens
GPLASPPAW

SEQ ID NO: 1393363 - protein, 9 aa, Homo Sapiens
TWWRTRACT

SEQ ID NO: 1393364 - protein, 9 aa, Homo Sapiens
VDIPAKKGL

SEQ ID NO: 1393365 - protein, 9 aa, Homo Sapiens
IPYVMKTGS

SEQ ID NO: 1393366 - protein, 9 aa, Homo Sapiens
RKCYGHGVG

SEQ ID NO: 1393367 - protein, 9 aa, Homo Sapiens
CIASVRPVE

SEQ ID NO: 1393368 - protein, 9 aa, Homo Sapiens
APGLITIGA

SEQ ID NO: 1393369 - protein, 9 aa, Homo Sapiens
GPQTILLAY

SEQ ID NO: 1393370 - protein, 9 aa, Homo Sapiens
LYSGYLIDA

SEQ ID NO: 1393371 - protein, 9 aa, Homo Sapiens
KVYTCISVN

SEQ ID NO: 1393372 - protein, 9 aa, Homo Sapiens
HLRTRIDRC

SEQ ID NO: 1393373 - protein, 9 aa, Homo Sapiens
AEEWGCPFI

SEQ ID NO: 1393374 - protein, 9 aa, Homo Sapiens
ICCGYIPSS

SEQ ID NO: 1393375 - protein, 9 aa, Homo Sapiens
AGGTNFWGV

SEQ ID NO: 1393376 - protein, 9 aa, Homo Sapiens
LSTSAPTMA

SEQ ID NO: 1393377 - protein, 9 aa, Homo Sapiens
VICDSCTVN

SEQ ID NO: 1393378 - protein, 9 aa, Homo Sapiens
TTTSSPRRS

SEQ ID NO: 1393379 - protein, 9 aa, Homo Sapiens
INKIRIFKE

SEQ ID NO: 1393380 - protein, 9 aa, Homo Sapiens
YDVLHSELN

SEQ ID NO: 1393381 - protein, 9 aa, Homo Sapiens
GHHSQPVQE

SEQ ID NO: 1393382 - protein, 9 aa, Homo Sapiens
GAAGYGGAH

SEQ ID NO: 1393383 - protein, 9 aa, Homo Sapiens
DGKDGLMAH

SEQ ID NO: 1393384 - protein, 9 aa, Homo Sapiens
EAERLEAHF

SEQ ID NO: 1393385 - protein, 9 aa, Homo Sapiens
VGGEITDDL

SEQ ID NO: 1393386 - protein, 9 aa, Homo Sapiens
VRLEASWQP

SEQ ID NO: 1393387 - protein, 9 aa, Homo Sapiens
ITSSLSASS

SEQ ID NO: 1393388 - protein, 9 aa, Homo Sapiens
FIFMGVIEF

SEQ ID NO: 1393389 - protein, 9 aa, Homo Sapiens
FVDNFVSRL

SEQ ID NO: 1393390 - protein, 9 aa, Homo Sapiens
RDQCFQMME

SEQ ID NO: 1393391 - protein, 9 aa, Homo Sapiens
QEPSLRSSW

SEQ ID NO: 1393392 - protein, 9 aa, Homo Sapiens
IEAPPPSTA

SEQ ID NO: 1393393 - protein, 9 aa, Homo Sapiens
WTPHSPDPS

SEQ ID NO: 1393394 - protein, 9 aa, Homo Sapiens
PPELPPASP

SEQ ID NO: 1393395 - protein, 9 aa, Homo Sapiens
EFKRISATT

SEQ ID NO: 1393396 - protein, 9 aa, Homo Sapiens
LLKTLNMIQ

SEQ ID NO: 1393397 - protein, 9 aa, Homo Sapiens
MQLWRQDRG

SEQ ID NO: 1393398 - protein, 9 aa, Homo Sapiens
FSSKVVHIM

SEQ ID NO: 1393399 - protein, 9 aa, Homo Sapiens
CHLYSLSVD

SEQ ID NO: 1393400 - protein, 9 aa, Homo Sapiens
DKPPNPELP

SEQ ID NO: 1393401 - protein, 9 aa, Homo Sapiens
NHYMEMVKN

SEQ ID NO: 1393402 - protein, 9 aa, Homo Sapiens
ASLHPASGR

SEQ ID NO: 1393403 - protein, 9 aa, Homo Sapiens
ALSQSEDGV

SEQ ID NO: 1393404 - protein, 9 aa, Homo Sapiens
DGLCSKTVD

SEQ ID NO: 1393405 - protein, 9 aa, Homo Sapiens
EKERRPRKK

SEQ ID NO: 1393406 - protein, 9 aa, Homo Sapiens
MGIFELEHL

SEQ ID NO: 1393407 - protein, 9 aa, Homo Sapiens
TTATQTLMT

SEQ ID NO: 1393408 - protein, 9 aa, Homo Sapiens
FYHHRLIIY

SEQ ID NO: 1393409 - protein, 9 aa, Homo Sapiens
EKERRERAA

SEQ ID NO: 1393410 - protein, 9 aa, Homo Sapiens
PVGFIHQAS

SEQ ID NO: 1393411 - protein, 9 aa, Homo Sapiens
RWPGLPGPT

SEQ ID NO: 1393412 - protein, 9 aa, Homo Sapiens
QPPTLPWTL

SEQ ID NO: 1393413 - protein, 9 aa, Homo Sapiens
LPAPRMRGN

SEQ ID NO: 1393414 - protein, 9 aa, Homo Sapiens
RETYCACRA

SEQ ID NO: 1393415 - protein, 9 aa, Homo Sapiens
THVYIASTR

SEQ ID NO: 1393416 - protein, 9 aa, Homo Sapiens
FFSTPEGYD

SEQ ID NO: 1393417 - protein, 9 aa, Homo Sapiens
GGGSSYSCG

SEQ ID NO: 1393418 - protein, 9 aa, Homo Sapiens
EMTHTGEKL

SEQ ID NO: 1393419 - protein, 9 aa, Homo Sapiens
SGPPPSPSR

SEQ ID NO: 1393420 - protein, 9 aa, Homo Sapiens
YYRKMYGDV

SEQ ID NO: 1393421 - protein, 9 aa, Homo Sapiens
SRPAWCCSW

SEQ ID NO: 1393422 - protein, 9 aa, Homo Sapiens
KEQSLWKLM

SEQ ID NO: 1393423 - protein, 9 aa, Homo Sapiens
TNTYISLIL

SEQ ID NO: 1393424 - protein, 9 aa, Homo Sapiens
VLEYLTVEI

SEQ ID NO: 1393425 - protein, 9 aa, Homo Sapiens
PHRPGLGTV

SEQ ID NO: 1393426 - protein, 9 aa, Homo Sapiens
YRPNMEGYR

SEQ ID NO: 1393427 - protein, 9 aa, Homo Sapiens
GVKMEATPF

SEQ ID NO: 1393428 - protein, 9 aa, Homo Sapiens
IASTRLFTA

SEQ ID NO: 1393429 - protein, 9 aa, Homo Sapiens
CHLCLEPPD

SEQ ID NO: 1393430 - protein, 9 aa, Homo Sapiens
KVCYDLTRE

SEQ ID NO: 1393431 - protein, 9 aa, Homo Sapiens
FGSALQVMG

SEQ ID NO: 1393432 - protein, 9 aa, Homo Sapiens
SSGGAGCGG

SEQ ID NO: 1393433 - protein, 9 aa, Homo Sapiens
ASGCPRPLS

SEQ ID NO: 1393434 - protein, 9 aa, Homo Sapiens
TGFILSVAL

SEQ ID NO: 1393435 - protein, 9 aa, Homo Sapiens
VASTTHKEL

SEQ ID NO: 1393436 - protein, 9 aa, Homo Sapiens
KCRVPAPLL

SEQ ID NO: 1393437 - protein, 9 aa, Homo Sapiens
AAGYGGAHP

SEQ ID NO: 1393438 - protein, 9 aa, Homo Sapiens
YVQAGWPCW

SEQ ID NO: 1393439 - protein, 9 aa, Homo Sapiens
KCIHLVQIV

SEQ ID NO: 1393440 - protein, 9 aa, Homo Sapiens
TQSLAAETT

SEQ ID NO: 1393441 - protein, 9 aa, Homo Sapiens
PLHLQNSVL

SEQ ID NO: 1393442 - protein, 9 aa, Homo Sapiens
LPSCKKKSS

SEQ ID NO: 1393443 - protein, 9 aa, Homo Sapiens
GKDGLMAHA

SEQ ID NO: 1393444 - protein, 9 aa, Homo Sapiens
LELQPPGDC

SEQ ID NO: 1393445 - protein, 9 aa, Homo Sapiens
RIAWQSITM

SEQ ID NO: 1393446 - protein, 9 aa, Homo Sapiens
DPPAQPALR

SEQ ID NO: 1393447 - protein, 9 aa, Homo Sapiens
CENCKPLRR

SEQ ID NO: 1393448 - protein, 9 aa, Homo Sapiens
GNFLHVNTL

SEQ ID NO: 1393449 - protein, 9 aa, Homo Sapiens
PKATPELRS

SEQ ID NO: 1393450 - protein, 9 aa, Homo Sapiens
IPLSDSPPL

SEQ ID NO: 1393451 - protein, 9 aa, Homo Sapiens
GSDEEVCGT

SEQ ID NO: 1393452 - protein, 9 aa, Homo Sapiens
GPARSARRW

SEQ ID NO: 1393453 - protein, 9 aa, Homo Sapiens
ASNGDVNAR

SEQ ID NO: 1393454 - protein, 9 aa, Homo Sapiens
DASDVLQAI

SEQ ID NO: 1393455 - protein, 9 aa, Homo Sapiens
SAACHRRGC

SEQ ID NO: 1393456 - protein, 9 aa, Homo Sapiens
LFQLGPLHL

SEQ ID NO: 1393457 - protein, 9 aa, Homo Sapiens
YGMVAPHTL

SEQ ID NO: 1393458 - protein, 9 aa, Homo Sapiens
LGERAAQCP

SEQ ID NO: 1393459 - protein, 9 aa, Homo Sapiens
CQAIEELYY

SEQ ID NO: 1393460 - protein, 9 aa, Homo Sapiens
FRDRKCYGH

SEQ ID NO: 1393461 - protein, 9 aa, Homo Sapiens
PTSCPPLLE

SEQ ID NO: 1393462 - protein, 9 aa, Homo Sapiens
LALVFGLLL

SEQ ID NO: 1393463 - protein, 9 aa, Homo Sapiens
RAEPGGRPW

SEQ ID NO: 1393464 - protein, 9 aa, Homo Sapiens
TKRKGECNH

SEQ ID NO: 1393465 - protein, 9 aa, Homo Sapiens
FLRLRRPGN

SEQ ID NO: 1393466 - protein, 9 aa, Homo Sapiens
KKVVEEEKL

SEQ ID NO: 1393467 - protein, 9 aa, Homo Sapiens
LWRLFLIIQ

SEQ ID NO: 1393468 - protein, 9 aa, Homo Sapiens
LFFHFPHCS

SEQ ID NO: 1393469 - protein, 9 aa, Homo Sapiens
SELVNKTRW

SEQ ID NO: 1393470 - protein, 9 aa, Homo Sapiens
KEMDNTGQL

SEQ ID NO: 1393471 - protein, 9 aa, Homo Sapiens
QCPLLDCRS

SEQ ID NO: 1393472 - protein, 9 aa, Homo Sapiens
DPDIGGSGR

SEQ ID NO: 1393473 - protein, 9 aa, Homo Sapiens
DHIRVQAQV

SEQ ID NO: 1393474 - protein, 9 aa, Homo Sapiens
RTSSMPEQV

SEQ ID NO: 1393475 - protein, 9 aa, Homo Sapiens
PGPTVPDLP

SEQ ID NO: 1393476 - protein, 9 aa, Homo Sapiens
IGCGGIIMA

SEQ ID NO: 1393477 - protein, 9 aa, Homo Sapiens
ATHCKYYST

SEQ ID NO: 1393478 - protein, 9 aa, Homo Sapiens
RAQALLAGS

SEQ ID NO: 1393479 - protein, 9 aa, Homo Sapiens
DGLYNFSDG

SEQ ID NO: 1393480 - protein, 9 aa, Homo Sapiens
DNRSCQNIN

SEQ ID NO: 1393481 - protein, 9 aa, Homo Sapiens
IGKTDPNSR

SEQ ID NO: 1393482 - protein, 9 aa, Homo Sapiens
DTSECMTAH

SEQ ID NO: 1393483 - protein, 9 aa, Homo Sapiens
NWKKPWKNS

SEQ ID NO: 1393484 - protein, 9 aa, Homo Sapiens
GSGSGCGGG

SEQ ID NO: 1393485 - protein, 9 aa, Homo Sapiens
QLALGMPSM

SEQ ID NO: 1393486 - protein, 9 aa, Homo Sapiens
QLSEDEEDS

SEQ ID NO: 1393487 - protein, 9 aa, Homo Sapiens
ISPVIYDSD

SEQ ID NO: 1393488 - protein, 9 aa, Homo Sapiens
LDHTRADLI

SEQ ID NO: 1393489 - protein, 9 aa, Homo Sapiens
HLQALFQVA

SEQ ID NO: 1393490 - protein, 9 aa, Homo Sapiens
GNGCPDSGM

SEQ ID NO: 1393491 - protein, 9 aa, Homo Sapiens
SHKSTSSSP

SEQ ID NO: 1393492 - protein, 9 aa, Homo Sapiens
DMHTDVIHS

SEQ ID NO: 1393493 - protein, 9 aa, Homo Sapiens
QSLAAETTE

SEQ ID NO: 1393494 - protein, 9 aa, Homo Sapiens
MVIGASDIL

SEQ ID NO: 1393495 - protein, 9 aa, Homo Sapiens
SGKSNFFMQ

SEQ ID NO: 1393496 - protein, 9 aa, Homo Sapiens
CTGKVCYDL

SEQ ID NO: 1393497 - protein, 9 aa, Homo Sapiens
REREHIHAK

SEQ ID NO: 1393498 - protein, 9 aa, Homo Sapiens
RHDIRREEA

SEQ ID NO: 1393499 - protein, 9 aa, Homo Sapiens
QKCIHLVQI

SEQ ID NO: 1393500 - protein, 9 aa, Homo Sapiens
HCQEVRISP

SEQ ID NO: 1393501 - protein, 9 aa, Homo Sapiens
ADSLSDKSS

SEQ ID NO: 1393502 - protein, 9 aa, Homo Sapiens
RGSTARGCR

SEQ ID NO: 1393503 - protein, 9 aa, Homo Sapiens
TLFSWHTPL

SEQ ID NO: 1393504 - protein, 9 aa, Homo Sapiens
PVLLSRWTE

SEQ ID NO: 1393505 - protein, 9 aa, Homo Sapiens
PHSPDPSMT

SEQ ID NO: 1393506 - protein, 9 aa, Homo Sapiens
TSPSQGILG

SEQ ID NO: 1393507 - protein, 9 aa, Homo Sapiens
PNTKDRLIK

SEQ ID NO: 1393508 - protein, 9 aa, Homo Sapiens
GAPRHPHRS

SEQ ID NO: 1393509 - protein, 9 aa, Homo Sapiens
RLEASWQPA

SEQ ID NO: 1393510 - protein, 9 aa, Homo Sapiens
WDDLINKIT

SEQ ID NO: 1393511 - protein, 9 aa, Homo Sapiens
LEAHFQDVR

SEQ ID NO: 1393512 - protein, 9 aa, Homo Sapiens
VQNSGWLYC

SEQ ID NO: 1393513 - protein, 9 aa, Homo Sapiens
NRSCQNINE

SEQ ID NO: 1393514 - protein, 9 aa, Homo Sapiens
HGHEAETLA

SEQ ID NO: 1393515 - protein, 9 aa, Homo Sapiens
KPSACDACV

SEQ ID NO: 1393516 - protein, 9 aa, Homo Sapiens
DANLCKNEL

SEQ ID NO: 1393517 - protein, 9 aa, Homo Sapiens
PIGWAALLL

SEQ ID NO: 1393518 - protein, 9 aa, Homo Sapiens
LDSKDLEEE

SEQ ID NO: 1393519 - protein, 9 aa, Homo Sapiens
SGQPSDVGS

SEQ ID NO: 1393520 - protein, 9 aa, Homo Sapiens
KKGQHFYWH

SEQ ID NO: 1393521 - protein, 9 aa, Homo Sapiens
RQPSQQLRK

SEQ ID NO: 1393522 - protein, 9 aa, Homo Sapiens
KNGGGLKRK

SEQ ID NO: 1393523 - protein, 9 aa, Homo Sapiens
TKKKGAKAR

SEQ ID NO: 1393524 - protein, 9 aa, Homo Sapiens
YCHLYSLSV

SEQ ID NO: 1393525 - protein, 9 aa, Homo Sapiens
HPGDGDAHS

SEQ ID NO: 1393526 - protein, 9 aa, Homo Sapiens
GWRGWWGNG

SEQ ID NO: 1393527 - protein, 9 aa, Homo Sapiens
RFQMIRTLN

SEQ ID NO: 1393528 - protein, 9 aa, Homo Sapiens
HALAQAIAV

SEQ ID NO: 1393529 - protein, 9 aa, Homo Sapiens
RTRACTPAS

SEQ ID NO: 1393530 - protein, 9 aa, Homo Sapiens
SPPMGVVQN

SEQ ID NO: 1393531 - protein, 9 aa, Homo Sapiens
CNGGMTPPK

SEQ ID NO: 1393532 - protein, 9 aa, Homo Sapiens
NPSMRAVRF

SEQ ID NO: 1393533 - protein, 9 aa, Homo Sapiens
EGAASQDTA

SEQ ID NO: 1393534 - protein, 9 aa, Homo Sapiens
TLNMIQVLM

SEQ ID NO: 1393535 - protein, 9 aa, Homo Sapiens
GGGPRAIDG

SEQ ID NO: 1393536 - protein, 9 aa, Homo Sapiens
TYINSLTIL

SEQ ID NO: 1393537 - protein, 9 aa, Homo Sapiens
QQHGRRLLL

SEQ ID NO: 1393538 - protein, 9 aa, Homo Sapiens
DGDPGDIGA

SEQ ID NO: 1393539 - protein, 9 aa, Homo Sapiens
GFILSVALD

SEQ ID NO: 1393540 - protein, 9 aa, Homo Sapiens
CSLGSRLHS

SEQ ID NO: 1393541 - protein, 9 aa, Homo Sapiens
YLIMISALV

SEQ ID NO: 1393542 - protein, 9 aa, Homo Sapiens
KFLSPQWAT

SEQ ID NO: 1393543 - protein, 9 aa, Homo Sapiens
QQPHHLPQQ

SEQ ID NO: 1393544 - protein, 9 aa, Homo Sapiens
SGKAKSHCL

SEQ ID NO: 1393545 - protein, 9 aa, Homo Sapiens
CSGQGTASP

SEQ ID NO: 1393546 - protein, 9 aa, Homo Sapiens
SPARSAAAA

SEQ ID NO: 1393547 - protein, 9 aa, Homo Sapiens
PLPRASLRA

SEQ ID NO: 1393548 - protein, 9 aa, Homo Sapiens
PPLQDGSLD

SEQ ID NO: 1393549 - protein, 9 aa, Homo Sapiens
IIIVHQRTH

SEQ ID NO: 1393550 - protein, 9 aa, Homo Sapiens
SKKVSTRKN

SEQ ID NO: 1393551 - protein, 9 aa, Homo Sapiens
ASGPSPARS

SEQ ID NO: 1393552 - protein, 9 aa, Homo Sapiens
EAEKGKEHV

SEQ ID NO: 1393553 - protein, 9 aa, Homo Sapiens
PSQETTRME

SEQ ID NO: 1393554 - protein, 9 aa, Homo Sapiens
TGANSLSSA

SEQ ID NO: 1393555 - protein, 9 aa, Homo Sapiens
ADGKYFSFF

SEQ ID NO: 1393556 - protein, 9 aa, Homo Sapiens
ILEIPTVNP

SEQ ID NO: 1393557 - protein, 9 aa, Homo Sapiens
SLLCSGQGT

SEQ ID NO: 1393558 - protein, 9 aa, Homo Sapiens
SSKEDLLVS

SEQ ID NO: 1393559 - protein, 9 aa, Homo Sapiens
ASTPARSPT

SEQ ID NO: 1393560 - protein, 9 aa, Homo Sapiens
RNLGSPLMS

SEQ ID NO: 1393561 - protein, 9 aa, Homo Sapiens
GHGRLVIVG

SEQ ID NO: 1393562 - protein, 9 aa, Homo Sapiens
HPPTTTTSS

SEQ ID NO: 1393563 - protein, 9 aa, Homo Sapiens
VGDCPKRPE

SEQ ID NO: 1393564 - protein, 9 aa, Homo Sapiens
RESSWLSRR

SEQ ID NO: 1393565 - protein, 9 aa, Homo Sapiens
MGVIEFYIL

SEQ ID NO: 1393566 - protein, 9 aa, Homo Sapiens
ALRFQGPAP

SEQ ID NO: 1393567 - protein, 9 aa, Homo Sapiens
PIEAPPPST

SEQ ID NO: 1393568 - protein, 9 aa, Homo Sapiens
YGKKLVKIS

SEQ ID NO: 1393569 - protein, 9 aa, Homo Sapiens
RATSGTAPS

SEQ ID NO: 1393570 - protein, 9 aa, Homo Sapiens
LISFKAALR

SEQ ID NO: 1393571 - protein, 9 aa, Homo Sapiens
QDLSSPSDF

SEQ ID NO: 1393572 - protein, 9 aa, Homo Sapiens
GKQGLGPPA

SEQ ID NO: 1393573 - protein, 9 aa, Homo Sapiens
CPKRPEQLP

SEQ ID NO: 1393574 - protein, 9 aa, Homo Sapiens
CTVNNHAFL

SEQ ID NO: 1393575 - protein, 9 aa, Homo Sapiens
YIRLRFQMI

SEQ ID NO: 1393576 - protein, 9 aa, Homo Sapiens
SQTGSLFKS

SEQ ID NO: 1393577 - protein, 9 aa, Homo Sapiens
RKTWQRRLR

SEQ ID NO: 1393578 - protein, 9 aa, Homo Sapiens
LWFFSKRIK

SEQ ID NO: 1393579 - protein, 9 aa, Homo Sapiens
EGFQDKRVL

SEQ ID NO: 1393580 - protein, 9 aa, Homo Sapiens
AEVPADDED

SEQ ID NO: 1393581 - protein, 9 aa, Homo Sapiens
AAPHTRLWM

SEQ ID NO: 1393582 - protein, 9 aa, Homo Sapiens
ESQGGVIKA

SEQ ID NO: 1393583 - protein, 9 aa, Homo Sapiens
VAAERQREH

SEQ ID NO: 1393584 - protein, 9 aa, Homo Sapiens
ATNPTWRRT

SEQ ID NO: 1393585 - protein, 9 aa, Homo Sapiens
HRQYGDRYI

SEQ ID NO: 1393586 - protein, 9 aa, Homo Sapiens
STASVGGSL

SEQ ID NO: 1393587 - protein, 9 aa, Homo Sapiens
GTNGGSSGG

SEQ ID NO: 1393588 - protein, 9 aa, Homo Sapiens
GRLWRPTAI

SEQ ID NO: 1393589 - protein, 9 aa, Homo Sapiens
AISRICEAV

SEQ ID NO: 1393590 - protein, 9 aa, Homo Sapiens
PPLRTTMKR

SEQ ID NO: 1393591 - protein, 9 aa, Homo Sapiens
YTCISVNTG

SEQ ID NO: 1393592 - protein, 9 aa, Homo Sapiens
IEADSLSDK

SEQ ID NO: 1393593 - protein, 9 aa, Homo Sapiens
VNLNWKFSG

SEQ ID NO: 1393594 - protein, 9 aa, Homo Sapiens
AYPIQVLTY

SEQ ID NO: 1393595 - protein, 9 aa, Homo Sapiens
LVYIMSTTG

SEQ ID NO: 1393596 - protein, 9 aa, Homo Sapiens
TGILVDTSG

SEQ ID NO: 1393597 - protein, 9 aa, Homo Sapiens
LVSMKSISA

SEQ ID NO: 1393598 - protein, 9 aa, Homo Sapiens
RLCRSEALY

SEQ ID NO: 1393599 - protein, 9 aa, Homo Sapiens
VLHSELNYV

SEQ ID NO: 1393600 - protein, 9 aa, Homo Sapiens
KEIAAACIH

SEQ ID NO: 1393601 - protein, 9 aa, Homo Sapiens
LINSVQQHR

SEQ ID NO: 1393602 - protein, 9 aa, Homo Sapiens
NKGQPIIAA

SEQ ID NO: 1393603 - protein, 9 aa, Homo Sapiens
CSWHLPTIS

SEQ ID NO: 1393604 - protein, 9 aa, Homo Sapiens
VVHIMTCCT

SEQ ID NO: 1393605 - protein, 9 aa, Homo Sapiens
NSQGTVFPL

SEQ ID NO: 1393606 - protein, 9 aa, Homo Sapiens
ALPVYIFTR

SEQ ID NO: 1393607 - protein, 9 aa, Homo Sapiens
AKDAVDLRK

SEQ ID NO: 1393608 - protein, 9 aa, Homo Sapiens
QPVQEAEVP

SEQ ID NO: 1393609 - protein, 9 aa, Homo Sapiens
ICSLLILIC

SEQ ID NO: 1393610 - protein, 9 aa, Homo Sapiens
NLTHLPNGL

SEQ ID NO: 1393611 - protein, 9 aa, Homo Sapiens
RSPTWCRTG

SEQ ID NO: 1393612 - protein, 9 aa, Homo Sapiens
GMGGSLGGG

SEQ ID NO: 1393613 - protein, 9 aa, Homo Sapiens
HLEYLKSPP

SEQ ID NO: 1393614 - protein, 9 aa, Homo Sapiens
PVQPVTKTI

SEQ ID NO: 1393615 - protein, 9 aa, Homo Sapiens
NHKVYIWHK

SEQ ID NO: 1393616 - protein, 9 aa, Homo Sapiens
ALHRQYGDR

SEQ ID NO: 1393617 - protein, 9 aa, Homo Sapiens
PVWPALLGS

SEQ ID NO: 1393618 - protein, 9 aa, Homo Sapiens
LLLLSPASR

SEQ ID NO: 1393619 - protein, 9 aa, Homo Sapiens
MVMIMGVKM

SEQ ID NO: 1393620 - protein, 9 aa, Homo Sapiens
FYTYKGKSL

SEQ ID NO: 1393621 - protein, 9 aa, Homo Sapiens
CLPPPTCPL

SEQ ID NO: 1393622 - protein, 9 aa, Homo Sapiens
YYMMDFLMS

SEQ ID NO: 1393623 - protein, 9 aa, Homo Sapiens
HSHWVLSPI

SEQ ID NO: 1393624 - protein, 9 aa, Homo Sapiens
LSSAEGGPP

SEQ ID NO: 1393625 - protein, 9 aa, Homo Sapiens
LPAISTMVS

SEQ ID NO: 1393626 - protein, 9 aa, Homo Sapiens
LPGQHLWLS

SEQ ID NO: 1393627 - protein, 9 aa, Homo Sapiens
AGTMLSERS

SEQ ID NO: 1393628 - protein, 9 aa, Homo Sapiens
QDTSECMTA

SEQ ID NO: 1393629 - protein, 9 aa, Homo Sapiens
LTLEKKIKI

SEQ ID NO: 1393630 - protein, 9 aa, Homo Sapiens
YQPEPGHTG

SEQ ID NO: 1393631 - protein, 9 aa, Homo Sapiens
SQTRYAQSR

SEQ ID NO: 1393632 - protein, 9 aa, Homo Sapiens
GLTPPPAAT

SEQ ID NO: 1393633 - protein, 9 aa, Homo Sapiens
TCAARSQLP

SEQ ID NO: 1393634 - protein, 9 aa, Homo Sapiens
SVPTILYSG

SEQ ID NO: 1393635 - protein, 9 aa, Homo Sapiens
TVQYICDRG

SEQ ID NO: 1393636 - protein, 9 aa, Homo Sapiens
SLRRMRTLW

SEQ ID NO: 1393637 - protein, 9 aa, Homo Sapiens
VLQHEYGPE

SEQ ID NO: 1393638 - protein, 9 aa, Homo Sapiens
DYGDISLRV

SEQ ID NO: 1393639 - protein, 9 aa, Homo Sapiens
SKALHGVTE

SEQ ID NO: 1393640 - protein, 9 aa, Homo Sapiens
MSLGEDLAT

SEQ ID NO: 1393641 - protein, 9 aa, Homo Sapiens
GLYNICSIY

SEQ ID NO: 1393642 - protein, 9 aa, Homo Sapiens
QRGSHWSRS

SEQ ID NO: 1393643 - protein, 9 aa, Homo Sapiens
SQPVKCGRV

SEQ ID NO: 1393644 - protein, 9 aa, Homo Sapiens
TSSLSASSP

SEQ ID NO: 1393645 - protein, 9 aa, Homo Sapiens
MTTSCLKFL

SEQ ID NO: 1393646 - protein, 9 aa, Homo Sapiens
VQAGWPCWL

SEQ ID NO: 1393647 - protein, 9 aa, Homo Sapiens
LDAMVNYFV

SEQ ID NO: 1393648 - protein, 9 aa, Homo Sapiens
KKGAKAREE

SEQ ID NO: 1393649 - protein, 9 aa, Homo Sapiens
ESHPHGSPG

SEQ ID NO: 1393650 - protein, 9 aa, Homo Sapiens
ESSGYSIIG

SEQ ID NO: 1393651 - protein, 9 aa, Homo Sapiens
HKRPRFQML

SEQ ID NO: 1393652 - protein, 9 aa, Homo Sapiens
ASSPQTPYC

SEQ ID NO: 1393653 - protein, 9 aa, Homo Sapiens
KMILSQLHH

SEQ ID NO: 1393654 - protein, 9 aa, Homo Sapiens
CSRRAPSCT

SEQ ID NO: 1393655 - protein, 9 aa, Homo Sapiens
INLIDVYGN

SEQ ID NO: 1393656 - protein, 9 aa, Homo Sapiens
SDKPPNPEL

SEQ ID NO: 1393657 - protein, 9 aa, Homo Sapiens
HLEGQFMYH

SEQ ID NO: 1393658 - protein, 9 aa, Homo Sapiens
VALRDNHLE

SEQ ID NO: 1393659 - protein, 9 aa, Homo Sapiens
LHRQYGDRY

SEQ ID NO: 1393660 - protein, 9 aa, Homo Sapiens
ATAQIQRPI

SEQ ID NO: 1393661 - protein, 9 aa, Homo Sapiens
RQISLPLRG

SEQ ID NO: 1393662 - protein, 9 aa, Homo Sapiens
TEYSYPLPK

SEQ ID NO: 1393663 - protein, 9 aa, Homo Sapiens
TGWLERAYG

SEQ ID NO: 1393664 - protein, 9 aa, Homo Sapiens
LNWKFSGVT

SEQ ID NO: 1393665 - protein, 9 aa, Homo Sapiens
SRSPRMRHR

SEQ ID NO: 1393666 - protein, 9 aa, Homo Sapiens
AACHRRGCV

SEQ ID NO: 1393667 - protein, 9 aa, Homo Sapiens
GDGLYNFSD

SEQ ID NO: 1393668 - protein, 9 aa, Homo Sapiens
FSSPILNAE

SEQ ID NO: 1393669 - protein, 9 aa, Homo Sapiens
LWLSHRLRL

SEQ ID NO: 1393670 - protein, 9 aa, Homo Sapiens
EESASPAVA

SEQ ID NO: 1393671 - protein, 9 aa, Homo Sapiens
GGGSVPWRL

SEQ ID NO: 1393672 - protein, 9 aa, Homo Sapiens
SASSKEDLL

SEQ ID NO: 1393673 - protein, 9 aa, Homo Sapiens
LAEFVNISR

SEQ ID NO: 1393674 - protein, 9 aa, Homo Sapiens
VEAAIHTKL

SEQ ID NO: 1393675 - protein, 9 aa, Homo Sapiens
EQIWLQINK

SEQ ID NO: 1393676 - protein, 9 aa, Homo Sapiens
KKCPLLLVY

SEQ ID NO: 1393677 - protein, 9 aa, Homo Sapiens
NFFMQFSLF

SEQ ID NO: 1393678 - protein, 9 aa, Homo Sapiens
FSQYERIIT

SEQ ID NO: 1393679 - protein, 9 aa, Homo Sapiens
SLKNGLHTS

SEQ ID NO: 1393680 - protein, 9 aa, Homo Sapiens
TLYRDMMLE

SEQ ID NO: 1393681 - protein, 9 aa, Homo Sapiens
KRPFLWDPA

SEQ ID NO: 1393682 - protein, 9 aa, Homo Sapiens
CTALQNNFQ

SEQ ID NO: 1393683 - protein, 9 aa, Homo Sapiens
AAAARKPHS

SEQ ID NO: 1393684 - protein, 9 aa, Homo Sapiens
EEEEQKKTH

SEQ ID NO: 1393685 - protein, 9 aa, Homo Sapiens
SSPSDFYST

SEQ ID NO: 1393686 - protein, 9 aa, Homo Sapiens
SKTYINSLT

SEQ ID NO: 1393687 - protein, 9 aa, Homo Sapiens
QRRLRACRA

SEQ ID NO: 1393688 - protein, 9 aa, Homo Sapiens
PVPTATAAS

SEQ ID NO: 1393689 - protein, 9 aa, Homo Sapiens
SAGRYVCEN

SEQ ID NO: 1393690 - protein, 9 aa, Homo Sapiens
KKKKTSRSQ

SEQ ID NO: 1393691 - protein, 9 aa, Homo Sapiens
TPELRSSEN

SEQ ID NO: 1393692 - protein, 9 aa, Homo Sapiens
AEKGKEHVN

SEQ ID NO: 1393693 - protein, 9 aa, Homo Sapiens
SVGGGDVED

SEQ ID NO: 1393694 - protein, 9 aa, Homo Sapiens
QPEFHALRA

SEQ ID NO: 1393695 - protein, 9 aa, Homo Sapiens
EQDTSECMT

SEQ ID NO: 1393696 - protein, 9 aa, Homo Sapiens
RGTSPSQGI

SEQ ID NO: 1393697 - protein, 9 aa, Homo Sapiens
VLPSCKKKS

SEQ ID NO: 1393698 - protein, 9 aa, Homo Sapiens
AGAFGEAFL

SEQ ID NO: 1393699 - protein, 9 aa, Homo Sapiens
RPFLWDPAS

SEQ ID NO: 1393700 - protein, 9 aa, Homo Sapiens
NWDDLINKI

SEQ ID NO: 1393701 - protein, 9 aa, Homo Sapiens
LGVCGHLKP

SEQ ID NO: 1393702 - protein, 9 aa, Homo Sapiens
SFLRLRRPG

SEQ ID NO: 1393703 - protein, 9 aa, Homo Sapiens
SPASRSLCR

SEQ ID NO: 1393704 - protein, 9 aa, Homo Sapiens
CGGGNARRT

SEQ ID NO: 1393705 - protein, 9 aa, Homo Sapiens
DVNARTAVI

SEQ ID NO: 1393706 - protein, 9 aa, Homo Sapiens
HGRWRLDSS

SEQ ID NO: 1393707 - protein, 9 aa, Homo Sapiens
GKSNFFMQF

SEQ ID NO: 1393708 - protein, 9 aa, Homo Sapiens
RCKREHSTL

SEQ ID NO: 1393709 - protein, 9 aa, Homo Sapiens
QTYMHPMKT

SEQ ID NO: 1393710 - protein, 9 aa, Homo Sapiens
MSTTGWLER

SEQ ID NO: 1393711 - protein, 9 aa, Homo Sapiens
VILALHSEE

SEQ ID NO: 1393712 - protein, 9 aa, Homo Sapiens
HFEELLVPK

SEQ ID NO: 1393713 - protein, 9 aa, Homo Sapiens
CPLGSEGCI

SEQ ID NO: 1393714 - protein, 9 aa, Homo Sapiens
PEYKLQVPR

SEQ ID NO: 1393715 - protein, 9 aa, Homo Sapiens
WLPEFIVQT

SEQ ID NO: 1393716 - protein, 9 aa, Homo Sapiens
VRAMHPYYL

SEQ ID NO: 1393717 - protein, 9 aa, Homo Sapiens
LEKKIKIGK

SEQ ID NO: 1393718 - protein, 9 aa, Homo Sapiens
GKRKNLIPC

SEQ ID NO: 1393719 - protein, 9 aa, Homo Sapiens
HHRLIIYEE

SEQ ID NO: 1393720 - protein, 9 aa, Homo Sapiens
EIASTYLIF

SEQ ID NO: 1393721 - protein, 9 aa, Homo Sapiens
DDTPEEILV

SEQ ID NO: 1393722 - protein, 9 aa, Homo Sapiens
SAGTMLSER

SEQ ID NO: 1393723 - protein, 9 aa, Homo Sapiens
SSILSSTLW

SEQ ID NO: 1393724 - protein, 9 aa, Homo Sapiens
VQQHREDIL

SEQ ID NO: 1393725 - protein, 9 aa, Homo Sapiens
PRRRRGSPG

SEQ ID NO: 1393726 - protein, 9 aa, Homo Sapiens
NLTPVQTLA

SEQ ID NO: 1393727 - protein, 9 aa, Homo Sapiens
QPPGDCPRT

SEQ ID NO: 1393728 - protein, 9 aa, Homo Sapiens
ESMKKVKCI

SEQ ID NO: 1393729 - protein, 9 aa, Homo Sapiens
GLQSGCGQH

SEQ ID NO: 1393730 - protein, 9 aa, Homo Sapiens
VQTPITGIL

SEQ ID NO: 1393731 - protein, 9 aa, Homo Sapiens
APVPVLSST

SEQ ID NO: 1393732 - protein, 9 aa, Homo Sapiens
GGNRSICLT

SEQ ID NO: 1393733 - protein, 9 aa, Homo Sapiens
RECDKAFNH

SEQ ID NO: 1393734 - protein, 9 aa, Homo Sapiens
PAGAFGEAF

SEQ ID NO: 1393735 - protein, 9 aa, Homo Sapiens
EKGKEHVNP

SEQ ID NO: 1393736 - protein, 9 aa, Homo Sapiens
WLCTSWVPR

SEQ ID NO: 1393737 - protein, 9 aa, Homo Sapiens
ENFSCTWNP

SEQ ID NO: 1393738 - protein, 9 aa, Homo Sapiens
SLLCEASTI

SEQ ID NO: 1393739 - protein, 9 aa, Homo Sapiens
TARTMLCFW

SEQ ID NO: 1393740 - protein, 9 aa, Homo Sapiens
RRHRDRHFG

SEQ ID NO: 1393741 - protein, 9 aa, Homo Sapiens
GNWIAHFRN

SEQ ID NO: 1393742 - protein, 9 aa, Homo Sapiens
GVQTVQQHG

SEQ ID NO: 1393743 - protein, 9 aa, Homo Sapiens
RIACKVWAG

SEQ ID NO: 1393744 - protein, 9 aa, Homo Sapiens
FRCSIRKSH

SEQ ID NO: 1393745 - protein, 9 aa, Homo Sapiens
KICACINSL

SEQ ID NO: 1393746 - protein, 9 aa, Homo Sapiens
LLKKCSLYG

SEQ ID NO: 1393747 - protein, 9 aa, Homo Sapiens
CRAHPMLKA

SEQ ID NO: 1393748 - protein, 9 aa, Homo Sapiens
KTYINSLTI

SEQ ID NO: 1393749 - protein, 9 aa, Homo Sapiens
GFQQQTEKP

SEQ ID NO: 1393750 - protein, 9 aa, Homo Sapiens
GPLELQPPG

SEQ ID NO: 1393751 - protein, 9 aa, Homo Sapiens
RRTGASTPA

SEQ ID NO: 1393752 - protein, 9 aa, Homo Sapiens
EKGDPGQPG

SEQ ID NO: 1393753 - protein, 9 aa, Homo Sapiens
VSFWSVWPV

SEQ ID NO: 1393754 - protein, 9 aa, Homo Sapiens
RLPAPHHQT

SEQ ID NO: 1393755 - protein, 9 aa, Homo Sapiens
SHPRLCRQL

SEQ ID NO: 1393756 - protein, 9 aa, Homo Sapiens
LCKNAGPRI

SEQ ID NO: 1393757 - protein, 9 aa, Homo Sapiens
ETYSSVCVL

SEQ ID NO: 1393758 - protein, 9 aa, Homo Sapiens
GGTNFWGVP

SEQ ID NO: 1393759 - protein, 9 aa, Homo Sapiens
HYFQQMSSW

SEQ ID NO: 1393760 - protein, 9 aa, Homo Sapiens
NQVPVQPEV

SEQ ID NO: 1393761 - protein, 9 aa, Homo Sapiens
LVAGVGLAA

SEQ ID NO: 1393762 - protein, 9 aa, Homo Sapiens
GEQIPGLLG

SEQ ID NO: 1393763 - protein, 9 aa, Homo Sapiens
CHSHHQRSR

SEQ ID NO: 1393764 - protein, 9 aa, Homo Sapiens
GHPCSRRAP

SEQ ID NO: 1393765 - protein, 9 aa, Homo Sapiens
FNYLRLVVR

SEQ ID NO: 1393766 - protein, 9 aa, Homo Sapiens
ENSHPPTTT

SEQ ID NO: 1393767 - protein, 9 aa, Homo Sapiens
TNVQIATKL

SEQ ID NO: 1393768 - protein, 9 aa, Homo Sapiens
GARGRTGAV

SEQ ID NO: 1393769 - protein, 9 aa, Homo Sapiens
SQLHHSMTR

SEQ ID NO: 1393770 - protein, 9 aa, Homo Sapiens
WDCPLDSKD

SEQ ID NO: 1393771 - protein, 9 aa, Homo Sapiens
GDTSEVSLF

SEQ ID NO: 1393772 - protein, 9 aa, Homo Sapiens
NPSDRQDWQ

SEQ ID NO: 1393773 - protein, 9 aa, Homo Sapiens
DRYKIDSLI

SEQ ID NO: 1393774 - protein, 9 aa, Homo Sapiens
ARVSFWSVW

SEQ ID NO: 1393775 - protein, 9 aa, Homo Sapiens
GAHPTPPMP

SEQ ID NO: 1393776 - protein, 9 aa, Homo Sapiens
HGRRLLLPR

SEQ ID NO: 1393777 - protein, 9 aa, Homo Sapiens
GDVNARTAV

SEQ ID NO: 1393778 - protein, 9 aa, Homo Sapiens
TRVWHPAIP

SEQ ID NO: 1393779 - protein, 9 aa, Homo Sapiens
VVDPGKASK

SEQ ID NO: 1393780 - protein, 9 aa, Homo Sapiens
PEEIEADSL

SEQ ID NO: 1393781 - protein, 9 aa, Homo Sapiens
PGQHLWLSH

SEQ ID NO: 1393782 - protein, 9 aa, Homo Sapiens
PRAIDGHRG

SEQ ID NO: 1393783 - protein, 9 aa, Homo Sapiens
SPNQNNWLC

SEQ ID NO: 1393784 - protein, 9 aa, Homo Sapiens
CDRDTQLTR

SEQ ID NO: 1393785 - protein, 9 aa, Homo Sapiens
CITECVRTA

SEQ ID NO: 1393786 - protein, 9 aa, Homo Sapiens
PEPLDGAVQ

SEQ ID NO: 1393787 - protein, 9 aa, Homo Sapiens
QGHTNRVCS

SEQ ID NO: 1393788 - protein, 9 aa, Homo Sapiens
HIRAGPNKI

SEQ ID NO: 1393789 - protein, 9 aa, Homo Sapiens
KVLVLVLFL

SEQ ID NO: 1393790 - protein, 9 aa, Homo Sapiens
FRGLLLLEV

SEQ ID NO: 1393791 - protein, 9 aa, Homo Sapiens
VRIGSGKYA

SEQ ID NO: 1393792 - protein, 9 aa, Homo Sapiens
MILSQLHHS

SEQ ID NO: 1393793 - protein, 9 aa, Homo Sapiens
LERTISSCL

SEQ ID NO: 1393794 - protein, 9 aa, Homo Sapiens
KAFSIKRGP

SEQ ID NO: 1393795 - protein, 9 aa, Homo Sapiens
QQVDIPIRL

SEQ ID NO: 1393796 - protein, 9 aa, Homo Sapiens
LDVGDCPKR

SEQ ID NO: 1393797 - protein, 9 aa, Homo Sapiens
YSVGSTSGN

SEQ ID NO: 1393798 - protein, 9 aa, Homo Sapiens
LGSRGGTNG

SEQ ID NO: 1393799 - protein, 9 aa, Homo Sapiens
VFGLLLLSP

SEQ ID NO: 1393800 - protein, 9 aa, Homo Sapiens
HPLHYNVLM

SEQ ID NO: 1393801 - protein, 9 aa, Homo Sapiens
DNQSVCSQG

SEQ ID NO: 1393802 - protein, 9 aa, Homo Sapiens
RVLRAYPIQ

SEQ ID NO: 1393803 - protein, 9 aa, Homo Sapiens
QPEPGHTGC

SEQ ID NO: 1393804 - protein, 9 aa, Homo Sapiens
RAAPAPPTT

SEQ ID NO: 1393805 - protein, 9 aa, Homo Sapiens
LCLCTCTWS

SEQ ID NO: 1393806 - protein, 9 aa, Homo Sapiens
RCKPNFFVT

SEQ ID NO: 1393807 - protein, 9 aa, Homo Sapiens
PGHPCSRRA

SEQ ID NO: 1393808 - protein, 9 aa, Homo Sapiens
LCLEPPDTS

SEQ ID NO: 1393809 - protein, 9 aa, Homo Sapiens
NGLHTSPPP

SEQ ID NO: 1393810 - protein, 9 aa, Homo Sapiens
ISIARRERP

SEQ ID NO: 1393811 - protein, 9 aa, Homo Sapiens
LTVIGQGLV

SEQ ID NO: 1393812 - protein, 9 aa, Homo Sapiens
RRRRGSPGS

SEQ ID NO: 1393813 - protein, 9 aa, Homo Sapiens
SQATGPPPA

SEQ ID NO: 1393814 - protein, 9 aa, Homo Sapiens
LLYYTEFLF

SEQ ID NO: 1393815 - protein, 9 aa, Homo Sapiens
SMKSISAAL

SEQ ID NO: 1393816 - protein, 9 aa, Homo Sapiens
SDERLCRSE

SEQ ID NO: 1393817 - protein, 9 aa, Homo Sapiens
TYSGPPPRA

SEQ ID NO: 1393818 - protein, 9 aa, Homo Sapiens
RVLAYIQSL

SEQ ID NO: 1393819 - protein, 9 aa, Homo Sapiens
TGDVDGPGG

SEQ ID NO: 1393820 - protein, 9 aa, Homo Sapiens
IPKATPELR

SEQ ID NO: 1393821 - protein, 9 aa, Homo Sapiens
CSSLTTHQA

SEQ ID NO: 1393822 - protein, 9 aa, Homo Sapiens
IVVKFFLQL

SEQ ID NO: 1393823 - protein, 9 aa, Homo Sapiens
LLASHHSVS

SEQ ID NO: 1393824 - protein, 9 aa, Homo Sapiens
LAGRRVWGA

SEQ ID NO: 1393825 - protein, 9 aa, Homo Sapiens
KRKFHFEEL

SEQ ID NO: 1393826 - protein, 9 aa, Homo Sapiens
RGMGGSLGG

SEQ ID NO: 1393827 - protein, 9 aa, Homo Sapiens
HSVLRGCLE

SEQ ID NO: 1393828 - protein, 9 aa, Homo Sapiens
QTLARSLVP

SEQ ID NO: 1393829 - protein, 9 aa, Homo Sapiens
TSYRSLLCP

SEQ ID NO: 1393830 - protein, 9 aa, Homo Sapiens
AGCGGGNAR

SEQ ID NO: 1393831 - protein, 9 aa, Homo Sapiens
SAFDRNFGT

SEQ ID NO: 1393832 - protein, 9 aa, Homo Sapiens
YGRLWRPTA

SEQ ID NO: 1393833 - protein, 9 aa, Homo Sapiens
PSFPEYMFN

SEQ ID NO: 1393834 - protein, 9 aa, Homo Sapiens
QTVLGPSVT

SEQ ID NO: 1393835 - protein, 9 aa, Homo Sapiens
RRRGSPGSL

SEQ ID NO: 1393836 - protein, 9 aa, Homo Sapiens
EPSQETTRM

SEQ ID NO: 1393837 - protein, 9 aa, Homo Sapiens
LMQKCIHLV

SEQ ID NO: 1393838 - protein, 9 aa, Homo Sapiens
RSYWTSWRT

SEQ ID NO: 1393839 - protein, 9 aa, Homo Sapiens
PERKCFPGN

SEQ ID NO: 1393840 - protein, 9 aa, Homo Sapiens
PSSSPKARV

SEQ ID NO: 1393841 - protein, 9 aa, Homo Sapiens
HFLTCSFKE

SEQ ID NO: 1393842 - protein, 9 aa, Homo Sapiens
GPRMGPVSP

SEQ ID NO: 1393843 - protein, 9 aa, Homo Sapiens
CQGRMFCSG

SEQ ID NO: 1393844 - protein, 9 aa, Homo Sapiens
QYQQILHQN

SEQ ID NO: 1393845 - protein, 9 aa, Homo Sapiens
AACIHMMPN

SEQ ID NO: 1393846 - protein, 9 aa, Homo Sapiens
FYFEVSGIR

SEQ ID NO: 1393847 - protein, 9 aa, Homo Sapiens
PGPPLSVPT

SEQ ID NO: 1393848 - protein, 9 aa, Homo Sapiens
EISTTRVPD

SEQ ID NO: 1393849 - protein, 9 aa, Homo Sapiens
PGLLGSPLL

SEQ ID NO: 1393850 - protein, 9 aa, Homo Sapiens
MRPDGRPEL

SEQ ID NO: 1393851 - protein, 9 aa, Homo Sapiens
YDNCCRLWC

SEQ ID NO: 1393852 - protein, 9 aa, Homo Sapiens
GSSPVGRLC

SEQ ID NO: 1393853 - protein, 9 aa, Homo Sapiens
IQVLMSVVH

SEQ ID NO: 1393854 - protein, 9 aa, Homo Sapiens
NLQEKLVEE

SEQ ID NO: 1393855 - protein, 9 aa, Homo Sapiens
SNFFMQFSL

SEQ ID NO: 1393856 - protein, 9 aa, Homo Sapiens
VGAMVNMDG

SEQ ID NO: 1393857 - protein, 9 aa, Homo Sapiens
PSKVLNKKK

SEQ ID NO: 1393858 - protein, 9 aa, Homo Sapiens
NECSECGKA

SEQ ID NO: 1393859 - protein, 9 aa, Homo Sapiens
GCPSQLRGS

SEQ ID NO: 1393860 - protein, 9 aa, Homo Sapiens
EQESQGGVI

SEQ ID NO: 1393861 - protein, 9 aa, Homo Sapiens
SQGILGSTG

SEQ ID NO: 1393862 - protein, 9 aa, Homo Sapiens
AIVVKFFLQ

SEQ ID NO: 1393863 - protein, 9 aa, Homo Sapiens
VRADTYCHL

SEQ ID NO: 1393864 - protein, 9 aa, Homo Sapiens
AGGAQLCKC

SEQ ID NO: 1393865 - protein, 9 aa, Homo Sapiens
RRTAGSTAS

SEQ ID NO: 1393866 - protein, 9 aa, Homo Sapiens
SIRQFVACL

SEQ ID NO: 1393867 - protein, 9 aa, Homo Sapiens
LTCSCNPEW

SEQ ID NO: 1393868 - protein, 9 aa, Homo Sapiens
VCDYILPVL

SEQ ID NO: 1393869 - protein, 9 aa, Homo Sapiens
LPWPASTCP

SEQ ID NO: 1393870 - protein, 9 aa, Homo Sapiens
QEAEVPADD

SEQ ID NO: 1393871 - protein, 9 aa, Homo Sapiens
GSVLWMSPA

SEQ ID NO: 1393872 - protein, 9 aa, Homo Sapiens
VVYASTTGA

SEQ ID NO: 1393873 - protein, 9 aa, Homo Sapiens
ISTTRVPDE

SEQ ID NO: 1393874 - protein, 9 aa, Homo Sapiens
WGPSRDSLP

SEQ ID NO: 1393875 - protein, 9 aa, Homo Sapiens
RTSQNHSKC

SEQ ID NO: 1393876 - protein, 9 aa, Homo Sapiens
RGAGSYIIM

SEQ ID NO: 1393877 - protein, 9 aa, Homo Sapiens
TTQRILALA

SEQ ID NO: 1393878 - protein, 9 aa, Homo Sapiens
QGRMFCSGN

SEQ ID NO: 1393879 - protein, 9 aa, Homo Sapiens
LQNSVLQAA

SEQ ID NO: 1393880 - protein, 9 aa, Homo Sapiens
LCEASTIVL

SEQ ID NO: 1393881 - protein, 9 aa, Homo Sapiens
IVGHGHEAE

SEQ ID NO: 1393882 - protein, 9 aa, Homo Sapiens
LQDVIGKTD

SEQ ID NO: 1393883 - protein, 9 aa, Homo Sapiens
WTFLEHFLI

SEQ ID NO: 1393884 - protein, 9 aa, Homo Sapiens
MVNMDGTAL

SEQ ID NO: 1393885 - protein, 9 aa, Homo Sapiens
SGPPPRARP

SEQ ID NO: 1393886 - protein, 9 aa, Homo Sapiens
REVHEWNDG

SEQ ID NO: 1393887 - protein, 9 aa, Homo Sapiens
KGAKAREEG

SEQ ID NO: 1393888 - protein, 9 aa, Homo Sapiens
VLCMAVTRQ

SEQ ID NO: 1393889 - protein, 9 aa, Homo Sapiens
RQLALGMPS

SEQ ID NO: 1393890 - protein, 9 aa, Homo Sapiens
AEEEEEGHQ

SEQ ID NO: 1393891 - protein, 9 aa, Homo Sapiens
NFSIYFCQG

SEQ ID NO: 1393892 - protein, 9 aa, Homo Sapiens
FVGNFLHVN

SEQ ID NO: 1393893 - protein, 9 aa, Homo Sapiens
EPGRPLRPL

SEQ ID NO: 1393894 - protein, 9 aa, Homo Sapiens
CCTVFWALI

SEQ ID NO: 1393895 - protein, 9 aa, Homo Sapiens
SVLRSWQLD

SEQ ID NO: 1393896 - protein, 9 aa, Homo Sapiens
GTRASSNPS

SEQ ID NO: 1393897 - protein, 9 aa, Homo Sapiens
DLPPPHLRQ

SEQ ID NO: 1393898 - protein, 9 aa, Homo Sapiens
GCPGLVPLP

SEQ ID NO: 1393899 - protein, 9 aa, Homo Sapiens
EQDVKEEAN

SEQ ID NO: 1393900 - protein, 9 aa, Homo Sapiens
SGGCHSHHQ

SEQ ID NO: 1393901 - protein, 9 aa, Homo Sapiens
LSPLSTLKP

SEQ ID NO: 1393902 - protein, 9 aa, Homo Sapiens
LPPGDTSEV

SEQ ID NO: 1393903 - protein, 9 aa, Homo Sapiens
CISIARRER

SEQ ID NO: 1393904 - protein, 9 aa, Homo Sapiens
PCPLPPQVP

SEQ ID NO: 1393905 - protein, 9 aa, Homo Sapiens
PFRCEIYGK

SEQ ID NO: 1393906 - protein, 9 aa, Homo Sapiens
SDPGVCIFG

SEQ ID NO: 1393907 - protein, 9 aa, Homo Sapiens
LDANPSSHR

SEQ ID NO: 1393908 - protein, 9 aa, Homo Sapiens
FTGPKAPCP

SEQ ID NO: 1393909 - protein, 9 aa, Homo Sapiens
CHKAQFVSQ

SEQ ID NO: 1393910 - protein, 9 aa, Homo Sapiens
GLKNIPGIR

SEQ ID NO: 1393911 - protein, 9 aa, Homo Sapiens
FFFIFMGVI

SEQ ID NO: 1393912 - protein, 9 aa, Homo Sapiens
KKKGQHFYW

SEQ ID NO: 1393913 - protein, 9 aa, Homo Sapiens
HSELNYVDI

SEQ ID NO: 1393914 - protein, 9 aa, Homo Sapiens
CSIRKSHVY

SEQ ID NO: 1393915 - protein, 9 aa, Homo Sapiens
EERRQSASC

SEQ ID NO: 1393916 - protein, 9 aa, Homo Sapiens
NMQGTRNVI

SEQ ID NO: 1393917 - protein, 9 aa, Homo Sapiens
STTGWLERA

SEQ ID NO: 1393918 - protein, 9 aa, Homo Sapiens
HSVSCSNIF

SEQ ID NO: 1393919 - protein, 9 aa, Homo Sapiens
VLERRGSLT

SEQ ID NO: 1393920 - protein, 9 aa, Homo Sapiens
LMSQEYSYQ

SEQ ID NO: 1393921 - protein, 9 aa, Homo Sapiens
THTYFYTRF

SEQ ID NO: 1393922 - protein, 9 aa, Homo Sapiens
CPLDSKDLE

SEQ ID NO: 1393923 - protein, 9 aa, Homo Sapiens
VLQKGKKRG

SEQ ID NO: 1393924 - protein, 9 aa, Homo Sapiens
PASTCPLPQ

SEQ ID NO: 1393925 - protein, 9 aa, Homo Sapiens
PKRPEQLPQ

SEQ ID NO: 1393926 - protein, 9 aa, Homo Sapiens
ALFQVATTE

SEQ ID NO: 1393927 - protein, 9 aa, Homo Sapiens
SQVCPEQFA

SEQ ID NO: 1393928 - protein, 9 aa, Homo Sapiens
CIVLCMAVT

SEQ ID NO: 1393929 - protein, 9 aa, Homo Sapiens
DLEVDNGAA

SEQ ID NO: 1393930 - protein, 9 aa, Homo Sapiens
SLGGWRGWW

SEQ ID NO: 1393931 - protein, 9 aa, Homo Sapiens
GASCTTQRI

SEQ ID NO: 1393932 - protein, 9 aa, Homo Sapiens
LFDIDRERR

SEQ ID NO: 1393933 - protein, 9 aa, Homo Sapiens
PKTIHEVNM

SEQ ID NO: 1393934 - protein, 9 aa, Homo Sapiens
RNIRERVEL

SEQ ID NO: 1393935 - protein, 9 aa, Homo Sapiens
LRTRIDRCR

SEQ ID NO: 1393936 - protein, 9 aa, Homo Sapiens
YRSLLCPGH

SEQ ID NO: 1393937 - protein, 9 aa, Homo Sapiens
SQSLRCTPQ

SEQ ID NO: 1393938 - protein, 9 aa, Homo Sapiens
PASGPSPAR

SEQ ID NO: 1393939 - protein, 9 aa, Homo Sapiens
PVQPEVTQV

SEQ ID NO: 1393940 - protein, 9 aa, Homo Sapiens
WQRRLRACR

SEQ ID NO: 1393941 - protein, 9 aa, Homo Sapiens
QGLVGMTPR

SEQ ID NO: 1393942 - protein, 9 aa, Homo Sapiens
PKSSPLPSS

SEQ ID NO: 1393943 - protein, 9 aa, Homo Sapiens
QAGWPCWLL

SEQ ID NO: 1393944 - protein, 9 aa, Homo Sapiens
FFMQFSLFS

SEQ ID NO: 1393945 - protein, 9 aa, Homo Sapiens
HFLISAFSS

SEQ ID NO: 1393946 - protein, 9 aa, Homo Sapiens
WSASCGPTS

SEQ ID NO: 1393947 - protein, 9 aa, Homo Sapiens
LQTIYGAET

SEQ ID NO: 1393948 - protein, 9 aa, Homo Sapiens
SPPEPEKER

SEQ ID NO: 1393949 - protein, 9 aa, Homo Sapiens
NYLRLVVRE

SEQ ID NO: 1393950 - protein, 9 aa, Homo Sapiens
EEEEGHQEL

SEQ ID NO: 1393951 - protein, 9 aa, Homo Sapiens
WKMTNVQIA

SEQ ID NO: 1393952 - protein, 9 aa, Homo Sapiens
ILEKLEKKD

SEQ ID NO: 1393953 - protein, 9 aa, Homo Sapiens
AIKRQKYER

SEQ ID NO: 1393954 - protein, 9 aa, Homo Sapiens
AQPTAIPSD

SEQ ID NO: 1393955 - protein, 9 aa, Homo Sapiens
LNSGYHFCV

SEQ ID NO: 1393956 - protein, 9 aa, Homo Sapiens
VGRSFFSTP

SEQ ID NO: 1393957 - protein, 9 aa, Homo Sapiens
PSCKKKSSC

SEQ ID NO: 1393958 - protein, 9 aa, Homo Sapiens
RYIRLRFQM

SEQ ID NO: 1393959 - protein, 9 aa, Homo Sapiens
LSQLFILCL

SEQ ID NO: 1393960 - protein, 9 aa, Homo Sapiens
PFLWDPASR

SEQ ID NO: 1393961 - protein, 9 aa, Homo Sapiens
QAGHHSQPV

SEQ ID NO: 1393962 - protein, 9 aa, Homo Sapiens
SVTTATQTL

SEQ ID NO: 1393963 - protein, 9 aa, Homo Sapiens
RSRLPGPPT

SEQ ID NO: 1393964 - protein, 9 aa, Homo Sapiens
QEEEEGIYR

SEQ ID NO: 1393965 - protein, 9 aa, Homo Sapiens
MIYLAHNAK

SEQ ID NO: 1393966 - protein, 9 aa, Homo Sapiens
PPELTVVTR

SEQ ID NO: 1393967 - protein, 9 aa, Homo Sapiens
GRPLRPLLQ

SEQ ID NO: 1393968 - protein, 9 aa, Homo Sapiens
AERLEAHFQ

SEQ ID NO: 1393969 - protein, 9 aa, Homo Sapiens
RRLPKPAKS

SEQ ID NO: 1393970 - protein, 9 aa, Homo Sapiens
LFLLVALSL

SEQ ID NO: 1393971 - protein, 9 aa, Homo Sapiens
GSRVRVGVQ

SEQ ID NO: 1393972 - protein, 9 aa, Homo Sapiens
VPILEIPTV

SEQ ID NO: 1393973 - protein, 9 aa, Homo Sapiens
LLSSVLRSW

SEQ ID NO: 1393974 - protein, 9 aa, Homo Sapiens
AVPRYHVGC

SEQ ID NO: 1393975 - protein, 9 aa, Homo Sapiens
EEEEEGHQE

SEQ ID NO: 1393976 - protein, 9 aa, Homo Sapiens
EDYPFGPVE

SEQ ID NO: 1393977 - protein, 9 aa, Homo Sapiens
PPNPELPGV

SEQ ID NO: 1393978 - protein, 9 aa, Homo Sapiens
RKKIEEAMD

SEQ ID NO: 1393979 - protein, 9 aa, Homo Sapiens
LHSELNYVD

SEQ ID NO: 1393980 - protein, 9 aa, Homo Sapiens
GLAGAMNSM

SEQ ID NO: 1393981 - protein, 9 aa, Homo Sapiens
DLTQLAVIT

SEQ ID NO: 1393982 - protein, 9 aa, Homo Sapiens
VAGVGLAAS

SEQ ID NO: 1393983 - protein, 9 aa, Homo Sapiens
TPEEILVRI

SEQ ID NO: 1393984 - protein, 9 aa, Homo Sapiens
SRLCRAHPM

SEQ ID NO: 1393985 - protein, 9 aa, Homo Sapiens
FSKRIKSAA

SEQ ID NO: 1393986 - protein, 9 aa, Homo Sapiens
ISVNTGELM

SEQ ID NO: 1393987 - protein, 9 aa, Homo Sapiens
PRRSPALRA

SEQ ID NO: 1393988 - protein, 9 aa, Homo Sapiens
GGGPATFHA

SEQ ID NO: 1393989 - protein, 9 aa, Homo Sapiens
HAGTASHKS

SEQ ID NO: 1393990 - protein, 9 aa, Homo Sapiens
HSHHQRSRR

SEQ ID NO: 1393991 - protein, 9 aa, Homo Sapiens
TDSEDEKGG

SEQ ID NO: 1393992 - protein, 9 aa, Homo Sapiens
CCGYIPSSL

SEQ ID NO: 1393993 - protein, 9 aa, Homo Sapiens
SAPEVPATA

SEQ ID NO: 1393994 - protein, 9 aa, Homo Sapiens
ICDIDRYRG

SEQ ID NO: 1393995 - protein, 9 aa, Homo Sapiens
HQELYVEDF

SEQ ID NO: 1393996 - protein, 9 aa, Homo Sapiens
IEDFLRNFL

SEQ ID NO: 1393997 - protein, 9 aa, Homo Sapiens
SGADINLID

SEQ ID NO: 1393998 - protein, 9 aa, Homo Sapiens
IEEKDPKKR

SEQ ID NO: 1393999 - protein, 9 aa, Homo Sapiens
PALKICACI

SEQ ID NO: 1394000 - protein, 9 aa, Homo Sapiens
PTTPSQHFT

SEQ ID NO: 1394001 - protein, 9 aa, Homo Sapiens
TAASVFYTV

SEQ ID NO: 1394002 - protein, 9 aa, Homo Sapiens
QILSTYQMT

SEQ ID NO: 1394003 - protein, 9 aa, Homo Sapiens
IRQFVACLV

SEQ ID NO: 1394004 - protein, 9 aa, Homo Sapiens
SHRLRLRLP

SEQ ID NO: 1394005 - protein, 9 aa, Homo Sapiens
GITLLPRAA

SEQ ID NO: 1394006 - protein, 9 aa, Homo Sapiens
LHLQNSVLQ

SEQ ID NO: 1394007 - protein, 9 aa, Homo Sapiens
STSVSRHSS

SEQ ID NO: 1394008 - protein, 9 aa, Homo Sapiens
TSSLIVTAA

SEQ ID NO: 1394009 - protein, 9 aa, Homo Sapiens
TFWEEGRIQ

SEQ ID NO: 1394010 - protein, 9 aa, Homo Sapiens
RKKPPRRKK

SEQ ID NO: 1394011 - protein, 9 aa, Homo Sapiens
LQLRWPGLP

SEQ ID NO: 1394012 - protein, 9 aa, Homo Sapiens
GCQKSLQKI

SEQ ID NO: 1394013 - protein, 9 aa, Homo Sapiens
QKWCMASMS

SEQ ID NO: 1394014 - protein, 9 aa, Homo Sapiens
FSVCSSLTT

SEQ ID NO: 1394015 - protein, 9 aa, Homo Sapiens
TLGAVQILT

SEQ ID NO: 1394016 - protein, 9 aa, Homo Sapiens
AQTIHQLAT

SEQ ID NO: 1394017 - protein, 9 aa, Homo Sapiens
LASPPAWDE

SEQ ID NO: 1394018 - protein, 9 aa, Homo Sapiens
ASLRRMRTL

SEQ ID NO: 1394019 - protein, 9 aa, Homo Sapiens
HRLIIYEEE

SEQ ID NO: 1394020 - protein, 9 aa, Homo Sapiens
LAVITSNTI

SEQ ID NO: 1394021 - protein, 9 aa, Homo Sapiens
SFLVALTRI

SEQ ID NO: 1394022 - protein, 9 aa, Homo Sapiens
PSTTRRDSW

SEQ ID NO: 1394023 - protein, 9 aa, Homo Sapiens
KRKKMFLIQ

SEQ ID NO: 1394024 - protein, 9 aa, Homo Sapiens
MRHRMRARL

SEQ ID NO: 1394025 - protein, 9 aa, Homo Sapiens
KGKKRGKRV

SEQ ID NO: 1394026 - protein, 9 aa, Homo Sapiens
ALPSILLTL

SEQ ID NO: 1394027 - protein, 9 aa, Homo Sapiens
WLPQGHQGP

SEQ ID NO: 1394028 - protein, 9 aa, Homo Sapiens
RVCSLQFDG

SEQ ID NO: 1394029 - protein, 9 aa, Homo Sapiens
LIPCGPARS

SEQ ID NO: 1394030 - protein, 9 aa, Homo Sapiens
QVPRIHRWT

SEQ ID NO: 1394031 - protein, 9 aa, Homo Sapiens
WFYFEVSGI

SEQ ID NO: 1394032 - protein, 9 aa, Homo Sapiens
SWHLPTISR

SEQ ID NO: 1394033 - protein, 9 aa, Homo Sapiens
RKALKFKKV

SEQ ID NO: 1394034 - protein, 9 aa, Homo Sapiens
RLCRQLALG

SEQ ID NO: 1394035 - protein, 9 aa, Homo Sapiens
HAQPEAAQQ

SEQ ID NO: 1394036 - protein, 9 aa, Homo Sapiens
FHYFQQMSS

SEQ ID NO: 1394037 - protein, 9 aa, Homo Sapiens
TCPRKAHPC

SEQ ID NO: 1394038 - protein, 9 aa, Homo Sapiens
RLRFQMIRT

SEQ ID NO: 1394039 - protein, 9 aa, Homo Sapiens
WKKPWKNSE

SEQ ID NO: 1394040 - protein, 9 aa, Homo Sapiens
IFELEHLPG

SEQ ID NO: 1394041 - protein, 9 aa, Homo Sapiens
KRKNLIPCG

SEQ ID NO: 1394042 - protein, 9 aa, Homo Sapiens
APEVPATAP

SEQ ID NO: 1394043 - protein, 9 aa, Homo Sapiens
HTSPPPGYP

SEQ ID NO: 1394044 - protein, 9 aa, Homo Sapiens
FHAGTASHK

SEQ ID NO: 1394045 - protein, 9 aa, Homo Sapiens
PGSLPKSSP

SEQ ID NO: 1394046 - protein, 9 aa, Homo Sapiens
RDRKCYGHG

SEQ ID NO: 1394047 - protein, 9 aa, Homo Sapiens
QNNWLCTSW

SEQ ID NO: 1394048 - protein, 9 aa, Homo Sapiens
MKVLVLVLF

SEQ ID NO: 1394049 - protein, 9 aa, Homo Sapiens
LDEVVAERL

SEQ ID NO: 1394050 - protein, 9 aa, Homo Sapiens
TPARSPTSA

SEQ ID NO: 1394051 - protein, 9 aa, Homo Sapiens
FLRNFLIKM

SEQ ID NO: 1394052 - protein, 9 aa, Homo Sapiens
PREPGRPLR

SEQ ID NO: 1394053 - protein, 9 aa, Homo Sapiens
GAGGGGPAT

SEQ ID NO: 1394054 - protein, 9 aa, Homo Sapiens
GAASQDTAL

SEQ ID NO: 1394055 - protein, 9 aa, Homo Sapiens
DQCFQMMEG

SEQ ID NO: 1394056 - protein, 9 aa, Homo Sapiens
MGFSRQVRV

SEQ ID NO: 1394057 - protein, 9 aa, Homo Sapiens
ELEKSNGTS

SEQ ID NO: 1394058 - protein, 9 aa, Homo Sapiens
ATVQYICDR

SEQ ID NO: 1394059 - protein, 9 aa, Homo Sapiens
PSDKPPNPE

SEQ ID NO: 1394060 - protein, 9 aa, Homo Sapiens
FLPAISTMV

SEQ ID NO: 1394061 - protein, 9 aa, Homo Sapiens
DGKKMDLDG

SEQ ID NO: 1394062 - protein, 9 aa, Homo Sapiens
SRICEAVPG

SEQ ID NO: 1394063 - protein, 9 aa, Homo Sapiens
EERQEILPD

SEQ ID NO: 1394064 - protein, 9 aa, Homo Sapiens
RGWWGNGWW

SEQ ID NO: 1394065 - protein, 9 aa, Homo Sapiens
WMRPKKCPL

SEQ ID NO: 1394066 - protein, 9 aa, Homo Sapiens
QSRMHWRAW

SEQ ID NO: 1394067 - protein, 9 aa, Homo Sapiens
IAMDVMCYT

SEQ ID NO: 1394068 - protein, 9 aa, Homo Sapiens
QNLQEKLVE

SEQ ID NO: 1394069 - protein, 9 aa, Homo Sapiens
EVSGIRPGV

SEQ ID NO: 1394070 - protein, 9 aa, Homo Sapiens
MLSPSAFIL

SEQ ID NO: 1394071 - protein, 9 aa, Homo Sapiens
PEEDASDVL

SEQ ID NO: 1394072 - protein, 9 aa, Homo Sapiens
QEYSYQDIQ

SEQ ID NO: 1394073 - protein, 9 aa, Homo Sapiens
QLWRQDRGG

SEQ ID NO: 1394074 - protein, 9 aa, Homo Sapiens
QSLRCTPQP

SEQ ID NO: 1394075 - protein, 9 aa, Homo Sapiens
NLKSGCVFI

SEQ ID NO: 1394076 - protein, 9 aa, Homo Sapiens
SPPTSCPPL

SEQ ID NO: 1394077 - protein, 9 aa, Homo Sapiens
VWPVESHPH

SEQ ID NO: 1394078 - protein, 9 aa, Homo Sapiens
AAPRPCWSR

SEQ ID NO: 1394079 - protein, 9 aa, Homo Sapiens
SQGGVIKAG

SEQ ID NO: 1394080 - protein, 9 aa, Homo Sapiens
NSFLVALTR

SEQ ID NO: 1394081 - protein, 9 aa, Homo Sapiens
SAPACLLGP

SEQ ID NO: 1394082 - protein, 9 aa, Homo Sapiens
TVIGQGLVG

SEQ ID NO: 1394083 - protein, 9 aa, Homo Sapiens
PTADPPAQP

SEQ ID NO: 1394084 - protein, 9 aa, Homo Sapiens
RTHVYIAST

SEQ ID NO: 1394085 - protein, 9 aa, Homo Sapiens
ETPANRYRS

SEQ ID NO: 1394086 - protein, 9 aa, Homo Sapiens
RTAHAMRER

SEQ ID NO: 1394087 - protein, 9 aa, Homo Sapiens
IENLMSQEY

SEQ ID NO: 1394088 - protein, 9 aa, Homo Sapiens
MITWKEIPK

SEQ ID NO: 1394089 - protein, 9 aa, Homo Sapiens
RIVCVTSAP

SEQ ID NO: 1394090 - protein, 9 aa, Homo Sapiens
YSGYLIDAT

SEQ ID NO: 1394091 - protein, 9 aa, Homo Sapiens
GGPRAIDGH

SEQ ID NO: 1394092 - protein, 9 aa, Homo Sapiens
PTGAEADGP

SEQ ID NO: 1394093 - protein, 9 aa, Homo Sapiens
KPPRRKKPS

SEQ ID NO: 1394094 - protein, 9 aa, Homo Sapiens
IACAHYPRE

SEQ ID NO: 1394095 - protein, 9 aa, Homo Sapiens
DSGADINLI

SEQ ID NO: 1394096 - protein, 9 aa, Homo Sapiens
EYPEEDASD

SEQ ID NO: 1394097 - protein, 9 aa, Homo Sapiens
TYRNIRERV

SEQ ID NO: 1394098 - protein, 9 aa, Homo Sapiens
TLWNFCLLP

SEQ ID NO: 1394099 - protein, 9 aa, Homo Sapiens
ESSWLPEFI

SEQ ID NO: 1394100 - protein, 9 aa, Homo Sapiens
ENEDAGFQQ

SEQ ID NO: 1394101 - protein, 9 aa, Homo Sapiens
CKNAGPRIK

SEQ ID NO: 1394102 - protein, 9 aa, Homo Sapiens
QGPWHHWNQ

SEQ ID NO: 1394103 - protein, 9 aa, Homo Sapiens
HTYFYTRFA

SEQ ID NO: 1394104 - protein, 9 aa, Homo Sapiens
PLCPWLPQG

SEQ ID NO: 1394105 - protein, 9 aa, Homo Sapiens
LKRAVEKVK

SEQ ID NO: 1394106 - protein, 9 aa, Homo Sapiens
VRAPFTQAE

SEQ ID NO: 1394107 - protein, 9 aa, Homo Sapiens
TAAGASGWS

SEQ ID NO: 1394108 - protein, 9 aa, Homo Sapiens
PKCRVPAPL

SEQ ID NO: 1394109 - protein, 9 aa, Homo Sapiens
SKCITECVR

SEQ ID NO: 1394110 - protein, 9 aa, Homo Sapiens
GVPGGHAQP

SEQ ID NO: 1394111 - protein, 9 aa, Homo Sapiens
LSSKLGIRG

SEQ ID NO: 1394112 - protein, 9 aa, Homo Sapiens
SCDSETTVM

SEQ ID NO: 1394113 - protein, 9 aa, Homo Sapiens
AGPSASLHP

SEQ ID NO: 1394114 - protein, 9 aa, Homo Sapiens
APAASMRPD

SEQ ID NO: 1394115 - protein, 9 aa, Homo Sapiens
LWDPASRLS

SEQ ID NO: 1394116 - protein, 9 aa, Homo Sapiens
LQSGCGQHP

SEQ ID NO: 1394117 - protein, 9 aa, Homo Sapiens
IYGAETRKE

SEQ ID NO: 1394118 - protein, 9 aa, Homo Sapiens
RTQTAATLQ

SEQ ID NO: 1394119 - protein, 9 aa, Homo Sapiens
AIFVMCWLP

SEQ ID NO: 1394120 - protein, 9 aa, Homo Sapiens
KTCGTMFTN

SEQ ID NO: 1394121 - protein, 9 aa, Homo Sapiens
TPRDLGTVA

SEQ ID NO: 1394122 - protein, 9 aa, Homo Sapiens
CVRPREQKE

SEQ ID NO: 1394123 - protein, 9 aa, Homo Sapiens
LITSSLSAS

SEQ ID NO: 1394124 - protein, 9 aa, Homo Sapiens
MHPMKTAGK

SEQ ID NO: 1394125 - protein, 9 aa, Homo Sapiens
SFPLEGLDM

SEQ ID NO: 1394126 - protein, 9 aa, Homo Sapiens
RKERAQSAE

SEQ ID NO: 1394127 - protein, 9 aa, Homo Sapiens
YMHPMKTAG

SEQ ID NO: 1394128 - protein, 9 aa, Homo Sapiens
RIDRCRRGF

SEQ ID NO: 1394129 - protein, 9 aa, Homo Sapiens
GGGNARRTA

SEQ ID NO: 1394130 - protein, 9 aa, Homo Sapiens
DLQEVLFHV

SEQ ID NO: 1394131 - protein, 9 aa, Homo Sapiens
IEERYRPNM

SEQ ID NO: 1394132 - protein, 9 aa, Homo Sapiens
FELDHTRAD

SEQ ID NO: 1394133 - protein, 9 aa, Homo Sapiens
LCQKEQSLW

SEQ ID NO: 1394134 - protein, 9 aa, Homo Sapiens
QRELLKTLN

SEQ ID NO: 1394135 - protein, 9 aa, Homo Sapiens
QRVQMVHFT

SEQ ID NO: 1394136 - protein, 9 aa, Homo Sapiens
AALLLYYLV

SEQ ID NO: 1394137 - protein, 9 aa, Homo Sapiens
EEKDPKKRS

SEQ ID NO: 1394138 - protein, 9 aa, Homo Sapiens
RGPSQLPHT

SEQ ID NO: 1394139 - protein, 9 aa, Homo Sapiens
VLPTRIAWQ

SEQ ID NO: 1394140 - protein, 9 aa, Homo Sapiens
KLDPQPFLR

SEQ ID NO: 1394141 - protein, 9 aa, Homo Sapiens
DAHSSGLTD

SEQ ID NO: 1394142 - protein, 9 aa, Homo Sapiens
WNLKSGCVF

SEQ ID NO: 1394143 - protein, 9 aa, Homo Sapiens
LQVRQDLSS

SEQ ID NO: 1394144 - protein, 9 aa, Homo Sapiens
QPREPGRPL

SEQ ID NO: 1394145 - protein, 9 aa, Homo Sapiens
RPRKKPPRR

SEQ ID NO: 1394146 - protein, 9 aa, Homo Sapiens
LYDIAKNAD

SEQ ID NO: 1394147 - protein, 9 aa, Homo Sapiens
LSHRLRLRL

SEQ ID NO: 1394148 - protein, 9 aa, Homo Sapiens
FMENEGASS

SEQ ID NO: 1394149 - protein, 9 aa, Homo Sapiens
TTPPIGPSC

SEQ ID NO: 1394150 - protein, 9 aa, Homo Sapiens
SVARPSTTR

SEQ ID NO: 1394151 - protein, 9 aa, Homo Sapiens
PVPVLSSTM

SEQ ID NO: 1394152 - protein, 9 aa, Homo Sapiens
EKVKKLLVP

SEQ ID NO: 1394153 - protein, 9 aa, Homo Sapiens
PTWCRTGAS

SEQ ID NO: 1394154 - protein, 9 aa, Homo Sapiens
QGLGPPAPP

SEQ ID NO: 1394155 - protein, 9 aa, Homo Sapiens
DVVNRGGRG

SEQ ID NO: 1394156 - protein, 9 aa, Homo Sapiens
ERKCFPGNQ

SEQ ID NO: 1394157 - protein, 9 aa, Homo Sapiens
SWLSRRTSL

SEQ ID NO: 1394158 - protein, 9 aa, Homo Sapiens
ARKQEEEEG

SEQ ID NO: 1394159 - protein, 9 aa, Homo Sapiens
QCWVLGHWA

SEQ ID NO: 1394160 - protein, 9 aa, Homo Sapiens
HGGTHAFGY

SEQ ID NO: 1394161 - protein, 9 aa, Homo Sapiens
PPAGRGAPR

SEQ ID NO: 1394162 - protein, 9 aa, Homo Sapiens
CFQMMEGKA

SEQ ID NO: 1394163 - protein, 9 aa, Homo Sapiens
WLSRRTSLS

SEQ ID NO: 1394164 - protein, 9 aa, Homo Sapiens
CIPAPVPVL

SEQ ID NO: 1394165 - protein, 9 aa, Homo Sapiens
TRASSNPSV

SEQ ID NO: 1394166 - protein, 9 aa, Homo Sapiens
GDISLRVGL

SEQ ID NO: 1394167 - protein, 9 aa, Homo Sapiens
LSYTNPAVT

SEQ ID NO: 1394168 - protein, 9 aa, Homo Sapiens
TPASGPSPA

SEQ ID NO: 1394169 - protein, 9 aa, Homo Sapiens
NTKDRLIKI

SEQ ID NO: 1394170 - protein, 9 aa, Homo Sapiens
FLSRPAWCC

SEQ ID NO: 1394171 - protein, 9 aa, Homo Sapiens
AMVNMDGTA

SEQ ID NO: 1394172 - protein, 9 aa, Homo Sapiens
RAYGRLWRP

SEQ ID NO: 1394173 - protein, 9 aa, Homo Sapiens
VPRKMILSQ

SEQ ID NO: 1394174 - protein, 9 aa, Homo Sapiens
FPLEGLDMR

SEQ ID NO: 1394175 - protein, 9 aa, Homo Sapiens
RTGASTRAS

SEQ ID NO: 1394176 - protein, 9 aa, Homo Sapiens
ASPRAAIWR

SEQ ID NO: 1394177 - protein, 9 aa, Homo Sapiens
LDDNRSCQN

SEQ ID NO: 1394178 - protein, 9 aa, Homo Sapiens
PEQAVGARK

SEQ ID NO: 1394179 - protein, 9 aa, Homo Sapiens
RRRPSRDSL

SEQ ID NO: 1394180 - protein, 9 aa, Homo Sapiens
PASSPAPPP

SEQ ID NO: 1394181 - protein, 9 aa, Homo Sapiens
QRLKDENAV

SEQ ID NO: 1394182 - protein, 9 aa, Homo Sapiens
SSLSASSPQ

SEQ ID NO: 1394183 - protein, 9 aa, Homo Sapiens
YPGPAARGM

SEQ ID NO: 1394184 - protein, 9 aa, Homo Sapiens
AQPALRPPA

SEQ ID NO: 1394185 - protein, 9 aa, Homo Sapiens
HSISILGVA

SEQ ID NO: 1394186 - protein, 9 aa, Homo Sapiens
IGWAALLLY

SEQ ID NO: 1394187 - protein, 9 aa, Homo Sapiens
KKKGAKARE

SEQ ID NO: 1394188 - protein, 9 aa, Homo Sapiens
SCTVNNHAF

SEQ ID NO: 1394189 - protein, 9 aa, Homo Sapiens
KPGAHSSHQ

SEQ ID NO: 1394190 - protein, 9 aa, Homo Sapiens
LLSQYPWKE

SEQ ID NO: 1394191 - protein, 9 aa, Homo Sapiens
YATLSLFYT

SEQ ID NO: 1394192 - protein, 9 aa, Homo Sapiens
SRDSLGAKG

SEQ ID NO: 1394193 - protein, 9 aa, Homo Sapiens
RRRRRERRS

SEQ ID NO: 1394194 - protein, 9 aa, Homo Sapiens
RISATTQCC

SEQ ID NO: 1394195 - protein, 9 aa, Homo Sapiens
RKMILSQLH

SEQ ID NO: 1394196 - protein, 9 aa, Homo Sapiens
SPTWCRTGA

SEQ ID NO: 1394197 - protein, 9 aa, Homo Sapiens
SMPGPKKAK

SEQ ID NO: 1394198 - protein, 9 aa, Homo Sapiens
SQRWKIPIG

SEQ ID NO: 1394199 - protein, 9 aa, Homo Sapiens
GVIKAGQAG

SEQ ID NO: 1394200 - protein, 9 aa, Homo Sapiens
FILCLCTCT

SEQ ID NO: 1394201 - protein, 9 aa, Homo Sapiens
HGYTCDYVG

SEQ ID NO: 1394202 - protein, 9 aa, Homo Sapiens
QRVQTPLLR

SEQ ID NO: 1394203 - protein, 9 aa, Homo Sapiens
YCIIAAVKI

SEQ ID NO: 1394204 - protein, 9 aa, Homo Sapiens
FEENMHVRA

SEQ ID NO: 1394205 - protein, 9 aa, Homo Sapiens
DNHLEIWSV

SEQ ID NO: 1394206 - protein, 9 aa, Homo Sapiens
ESVEDANPA

SEQ ID NO: 1394207 - protein, 9 aa, Homo Sapiens
SSTLWNFCL

SEQ ID NO: 1394208 - protein, 9 aa, Homo Sapiens
IPIGWAALL

SEQ ID NO: 1394209 - protein, 9 aa, Homo Sapiens
LLLYYLVTF

SEQ ID NO: 1394210 - protein, 9 aa, Homo Sapiens
DGAGAQANL

SEQ ID NO: 1394211 - protein, 9 aa, Homo Sapiens
VKMEATPFK

SEQ ID NO: 1394212 - protein, 9 aa, Homo Sapiens
PKICCPHSR

SEQ ID NO: 1394213 - protein, 9 aa, Homo Sapiens
SYSCGSGLG

SEQ ID NO: 1394214 - protein, 9 aa, Homo Sapiens
QMSVIWDKA

SEQ ID NO: 1394215 - protein, 9 aa, Homo Sapiens
RGRTQPSFA

SEQ ID NO: 1394216 - protein, 9 aa, Homo Sapiens
IPQKPNKRL

SEQ ID NO: 1394217 - protein, 9 aa, Homo Sapiens
KAKSHCLDH

SEQ ID NO: 1394218 - protein, 9 aa, Homo Sapiens
SWRTKEQSR

SEQ ID NO: 1394219 - protein, 9 aa, Homo Sapiens
TINDVGPVD

SEQ ID NO: 1394220 - protein, 9 aa, Homo Sapiens
SGPSPAPSA

SEQ ID NO: 1394221 - protein, 9 aa, Homo Sapiens
QECCCTSDV

SEQ ID NO: 1394222 - protein, 9 aa, Homo Sapiens
LSRRTSLSA

SEQ ID NO: 1394223 - protein, 9 aa, Homo Sapiens
KQECCCTSD

SEQ ID NO: 1394224 - protein, 9 aa, Homo Sapiens
EDISEADLV

SEQ ID NO: 1394225 - protein, 9 aa, Homo Sapiens
DDNRSCQNI

SEQ ID NO: 1394226 - protein, 9 aa, Homo Sapiens
AGGPAGWAR

SEQ ID NO: 1394227 - protein, 9 aa, Homo Sapiens
LVRAMHPYY

SEQ ID NO: 1394228 - protein, 9 aa, Homo Sapiens
WTSLKQMEE

SEQ ID NO: 1394229 - protein, 9 aa, Homo Sapiens
LCLLQHQGP

SEQ ID NO: 1394230 - protein, 9 aa, Homo Sapiens
QRPKPSSSP

SEQ ID NO: 1394231 - protein, 9 aa, Homo Sapiens
KSNFFMQFS

SEQ ID NO: 1394232 - protein, 9 aa, Homo Sapiens
LLVNMGGNR

SEQ ID NO: 1394233 - protein, 9 aa, Homo Sapiens
DRRRPSRDS

SEQ ID NO: 1394234 - protein, 9 aa, Homo Sapiens
YLLINSQVC

SEQ ID NO: 1394235 - protein, 9 aa, Homo Sapiens
LCFELERTI

SEQ ID NO: 1394236 - protein, 9 aa, Homo Sapiens
SQDYPDSQL

SEQ ID NO: 1394237 - protein, 9 aa, Homo Sapiens
SVKDHRTSQ

SEQ ID NO: 1394238 - protein, 9 aa, Homo Sapiens
STTGASEPR

SEQ ID NO: 1394239 - protein, 9 aa, Homo Sapiens
LVIFVQNSG

SEQ ID NO: 1394240 - protein, 9 aa, Homo Sapiens
AVHAIRGEE

SEQ ID NO: 1394241 - protein, 9 aa, Homo Sapiens
LNRYIEKSN

SEQ ID NO: 1394242 - protein, 9 aa, Homo Sapiens
APTGAEADG

SEQ ID NO: 1394243 - protein, 9 aa, Homo Sapiens
DEEEEQKKT

SEQ ID NO: 1394244 - protein, 9 aa, Homo Sapiens
AHPTPPMPT

SEQ ID NO: 1394245 - protein, 9 aa, Homo Sapiens
QLDANPSSH

SEQ ID NO: 1394246 - protein, 9 aa, Homo Sapiens
RASSNPSVG

SEQ ID NO: 1394247 - protein, 9 aa, Homo Sapiens
LSGARGRTG

SEQ ID NO: 1394248 - protein, 9 aa, Homo Sapiens
YRNIRERVE

SEQ ID NO: 1394249 - protein, 9 aa, Homo Sapiens
PKEEEEDDD

SEQ ID NO: 1394250 - protein, 9 aa, Homo Sapiens
RSSPKPKAQ

SEQ ID NO: 1394251 - protein, 9 aa, Homo Sapiens
YTEFLFLGL

SEQ ID NO: 1394252 - protein, 9 aa, Homo Sapiens
CPPGHPCSR

SEQ ID NO: 1394253 - protein, 9 aa, Homo Sapiens
LLLPRLHVR

SEQ ID NO: 1394254 - protein, 9 aa, Homo Sapiens
KKKKKTSRS

SEQ ID NO: 1394255 - protein, 9 aa, Homo Sapiens
TEYARPHVM

SEQ ID NO: 1394256 - protein, 9 aa, Homo Sapiens
TESLNRYIE

SEQ ID NO: 1394257 - protein, 9 aa, Homo Sapiens
SLTILDDEP

SEQ ID NO: 1394258 - protein, 9 aa, Homo Sapiens
SYPHSAWCV

SEQ ID NO: 1394259 - protein, 9 aa, Homo Sapiens
AHNAKDVSV

SEQ ID NO: 1394260 - protein, 9 aa, Homo Sapiens
GTSNWKKPW

SEQ ID NO: 1394261 - protein, 9 aa, Homo Sapiens
RLCVDAGFL

SEQ ID NO: 1394262 - protein, 9 aa, Homo Sapiens
RRRRRRRER

SEQ ID NO: 1394263 - protein, 9 aa, Homo Sapiens
PEMGLPPLP

SEQ ID NO: 1394264 - protein, 9 aa, Homo Sapiens
DKANFFQMV

SEQ ID NO: 1394265 - protein, 9 aa, Homo Sapiens
WNPPLVVCR

SEQ ID NO: 1394266 - protein, 9 aa, Homo Sapiens
LLILICDQL

SEQ ID NO: 1394267 - protein, 9 aa, Homo Sapiens
EEAHYYQLQ

SEQ ID NO: 1394268 - protein, 9 aa, Homo Sapiens
TLALVGGEI

SEQ ID NO: 1394269 - protein, 9 aa, Homo Sapiens
GEQESQGGV

SEQ ID NO: 1394270 - protein, 9 aa, Homo Sapiens
AASAGPPAG

SEQ ID NO: 1394271 - protein, 9 aa, Homo Sapiens
PNSTPPQRV

SEQ ID NO: 1394272 - protein, 9 aa, Homo Sapiens
GYSIIGSPS

SEQ ID NO: 1394273 - protein, 9 aa, Homo Sapiens
RGSQRAVRG

SEQ ID NO: 1394274 - protein, 9 aa, Homo Sapiens
EPVKVLQKG

SEQ ID NO: 1394275 - protein, 9 aa, Homo Sapiens
LSRPAWCCS

SEQ ID NO: 1394276 - protein, 9 aa, Homo Sapiens
RTSARRRTW

SEQ ID NO: 1394277 - protein, 9 aa, Homo Sapiens
LEILSFMGI

SEQ ID NO: 1394278 - protein, 9 aa, Homo Sapiens
IADGKYFSF

SEQ ID NO: 1394279 - protein, 9 aa, Homo Sapiens
RELLKTLNM

SEQ ID NO: 1394280 - protein, 9 aa, Homo Sapiens
SIIAEVHAQ

SEQ ID NO: 1394281 - protein, 9 aa, Homo Sapiens
RQNKKVVEE

SEQ ID NO: 1394282 - protein, 9 aa, Homo Sapiens
KTSSLIVTA

SEQ ID NO: 1394283 - protein, 9 aa, Homo Sapiens
REAISRICE

SEQ ID NO: 1394284 - protein, 9 aa, Homo Sapiens
ELFVLSYQD

SEQ ID NO: 1394285 - protein, 9 aa, Homo Sapiens
ATLCLLQHQ

SEQ ID NO: 1394286 - protein, 9 aa, Homo Sapiens
LQLLRTFMR

SEQ ID NO: 1394287 - protein, 9 aa, Homo Sapiens
PSQHFTGPK

SEQ ID NO: 1394288 - protein, 9 aa, Homo Sapiens
IITYDVLHS

SEQ ID NO: 1394289 - protein, 9 aa, Homo Sapiens
QSASCGCTL

SEQ ID NO: 1394290 - protein, 9 aa, Homo Sapiens
IVLCMAVTR

SEQ ID NO: 1394291 - protein, 9 aa, Homo Sapiens
GLLGSPLLS

SEQ ID NO: 1394292 - protein, 9 aa, Homo Sapiens
RRSPALRAR

SEQ ID NO: 1394293 - protein, 9 aa, Homo Sapiens
VNFLMVFIF

SEQ ID NO: 1394294 - protein, 9 aa, Homo Sapiens
VKGITEKSN

SEQ ID NO: 1394295 - protein, 9 aa, Homo Sapiens
GHTNRVCSL

SEQ ID NO: 1394296 - protein, 9 aa, Homo Sapiens
GDIGAELDD

SEQ ID NO: 1394297 - protein, 9 aa, Homo Sapiens
VPAPLLTWL

SEQ ID NO: 1394298 - protein, 9 aa, Homo Sapiens
DRAENLLHN

SEQ ID NO: 1394299 - protein, 9 aa, Homo Sapiens
RSVEQGCLK

SEQ ID NO: 1394300 - protein, 9 aa, Homo Sapiens
TCSFKEHFS

SEQ ID NO: 1394301 - protein, 9 aa, Homo Sapiens
TMLSERSAL

SEQ ID NO: 1394302 - protein, 9 aa, Homo Sapiens
FGPVENKIK

SEQ ID NO: 1394303 - protein, 9 aa, Homo Sapiens
ASAQPTAIP

SEQ ID NO: 1394304 - protein, 9 aa, Homo Sapiens
PLLHIRGDD

SEQ ID NO: 1394305 - protein, 9 aa, Homo Sapiens
LSDSPPLQD

SEQ ID NO: 1394306 - protein, 9 aa, Homo Sapiens
SGGAGCGGG

SEQ ID NO: 1394307 - protein, 9 aa, Homo Sapiens
SALQVMGMQ

SEQ ID NO: 1394308 - protein, 9 aa, Homo Sapiens
VWQDPLLGS

SEQ ID NO: 1394309 - protein, 9 aa, Homo Sapiens
LAYGESQRW

SEQ ID NO: 1394310 - protein, 9 aa, Homo Sapiens
PSPSRRLRS

SEQ ID NO: 1394311 - protein, 9 aa, Homo Sapiens
SPLNVIDLM

SEQ ID NO: 1394312 - protein, 9 aa, Homo Sapiens
VGGKAPGVQ

SEQ ID NO: 1394313 - protein, 9 aa, Homo Sapiens
ALLQQRHSV

SEQ ID NO: 1394314 - protein, 9 aa, Homo Sapiens
PGKASKAAW

SEQ ID NO: 1394315 - protein, 9 aa, Homo Sapiens
YPSLLEQQI

SEQ ID NO: 1394316 - protein, 9 aa, Homo Sapiens
SAGRTSARR

SEQ ID NO: 1394317 - protein, 9 aa, Homo Sapiens
NLLHNHYGG

SEQ ID NO: 1394318 - protein, 9 aa, Homo Sapiens
NSGYHFCVG

SEQ ID NO: 1394319 - protein, 9 aa, Homo Sapiens
LCSGQGTAS

SEQ ID NO: 1394320 - protein, 9 aa, Homo Sapiens
PCWSRCSLR

SEQ ID NO: 1394321 - protein, 9 aa, Homo Sapiens
RRRERRSDS

SEQ ID NO: 1394322 - protein, 9 aa, Homo Sapiens
TMLCFWTPH

SEQ ID NO: 1394323 - protein, 9 aa, Homo Sapiens
QVEQLCQAI

SEQ ID NO: 1394324 - protein, 9 aa, Homo Sapiens
HLVKNHDHP

SEQ ID NO: 1394325 - protein, 9 aa, Homo Sapiens
CVDAGFLSR

SEQ ID NO: 1394326 - protein, 9 aa, Homo Sapiens
FMGVIEFYI

SEQ ID NO: 1394327 - protein, 9 aa, Homo Sapiens
SGARGRTGA

SEQ ID NO: 1394328 - protein, 9 aa, Homo Sapiens
ARSAAAASP

SEQ ID NO: 1394329 - protein, 9 aa, Homo Sapiens
HSMTRFWRW

SEQ ID NO: 1394330 - protein, 9 aa, Homo Sapiens
VFLDIVPHL

SEQ ID NO: 1394331 - protein, 9 aa, Homo Sapiens
PAISTMVSS

SEQ ID NO: 1394332 - protein, 9 aa, Homo Sapiens
DLQHALAQA

SEQ ID NO: 1394333 - protein, 9 aa, Homo Sapiens
RPGNWIAHF

SEQ ID NO: 1394334 - protein, 9 aa, Homo Sapiens
PRDLGTVAG

SEQ ID NO: 1394335 - protein, 9 aa, Homo Sapiens
VAPLASAPE

SEQ ID NO: 1394336 - protein, 9 aa, Homo Sapiens
HAFGYGVGH

SEQ ID NO: 1394337 - protein, 9 aa, Homo Sapiens
FNSNSGVMC

SEQ ID NO: 1394338 - protein, 9 aa, Homo Sapiens
KVKKLLVPA

SEQ ID NO: 1394339 - protein, 9 aa, Homo Sapiens
QGGAPSAFD

SEQ ID NO: 1394340 - protein, 9 aa, Homo Sapiens
SLLNWTFLE

SEQ ID NO: 1394341 - protein, 9 aa, Homo Sapiens
CNHPWSICF

SEQ ID NO: 1394342 - protein, 9 aa, Homo Sapiens
PDLCNVDLV

SEQ ID NO: 1394343 - protein, 9 aa, Homo Sapiens
TSPVTWLIS

SEQ ID NO: 1394344 - protein, 9 aa, Homo Sapiens
ISALVALVF

SEQ ID NO: 1394345 - protein, 9 aa, Homo Sapiens
EMGLPPLPG

SEQ ID NO: 1394346 - protein, 9 aa, Homo Sapiens
YLKENAALP

SEQ ID NO: 1394347 - protein, 9 aa, Homo Sapiens
DIPIRLLVP

SEQ ID NO: 1394348 - protein, 9 aa, Homo Sapiens
FFVTLLYVN

SEQ ID NO: 1394349 - protein, 9 aa, Homo Sapiens
LFSVMSLVI

SEQ ID NO: 1394350 - protein, 9 aa, Homo Sapiens
AFNCFFTSL

SEQ ID NO: 1394351 - protein, 9 aa, Homo Sapiens
GPDKENPGA

SEQ ID NO: 1394352 - protein, 9 aa, Homo Sapiens
GEITDDLDV

SEQ ID NO: 1394353 - protein, 9 aa, Homo Sapiens
QGMELFVQQ

SEQ ID NO: 1394354 - protein, 9 aa, Homo Sapiens
IFTRPTYSR

SEQ ID NO: 1394355 - protein, 9 aa, Homo Sapiens
HSLGGHRLC

SEQ ID NO: 1394356 - protein, 9 aa, Homo Sapiens
LLVYIMSTT

SEQ ID NO: 1394357 - protein, 9 aa, Homo Sapiens
VIADGKYFS

SEQ ID NO: 1394358 - protein, 9 aa, Homo Sapiens
KSHTNTSHI

SEQ ID NO: 1394359 - protein, 9 aa, Homo Sapiens
SHHQRSRRH

SEQ ID NO: 1394360 - protein, 9 aa, Homo Sapiens
STMVSSYRD

SEQ ID NO: 1394361 - protein, 9 aa, Homo Sapiens
PTWRRTGAS

SEQ ID NO: 1394362 - protein, 9 aa, Homo Sapiens
RVFLDIVPH

SEQ ID NO: 1394363 - protein, 9 aa, Homo Sapiens
LCCHHWNKV

SEQ ID NO: 1394364 - protein, 9 aa, Homo Sapiens
CGADSNPRR

SEQ ID NO: 1394365 - protein, 9 aa, Homo Sapiens
ICHPLHYNV

SEQ ID NO: 1394366 - protein, 9 aa, Homo Sapiens
HEVNMQGTR

SEQ ID NO: 1394367 - protein, 9 aa, Homo Sapiens
APLLTWLEP

SEQ ID NO: 1394368 - protein, 9 aa, Homo Sapiens
VENEDAGFQ

SEQ ID NO: 1394369 - protein, 9 aa, Homo Sapiens
DSVTKGSVL

SEQ ID NO: 1394370 - protein, 9 aa, Homo Sapiens
GPPPAVGAR

SEQ ID NO: 1394371 - protein, 9 aa, Homo Sapiens
HPSAFNNLK

SEQ ID NO: 1394372 - protein, 9 aa, Homo Sapiens
QFMENEGAS

SEQ ID NO: 1394373 - protein, 9 aa, Homo Sapiens
SLLCPGHVS

SEQ ID NO: 1394374 - protein, 9 aa, Homo Sapiens
FIETSAKSK

SEQ ID NO: 1394375 - protein, 9 aa, Homo Sapiens
ILVDTSGLW

SEQ ID NO: 1394376 - protein, 9 aa, Homo Sapiens
AKAREEGYY

SEQ ID NO: 1394377 - protein, 9 aa, Homo Sapiens
GLPVGFIHQ

SEQ ID NO: 1394378 - protein, 9 aa, Homo Sapiens
LDPETPANR

SEQ ID NO: 1394379 - protein, 9 aa, Homo Sapiens
MKNLNFSVI

SEQ ID NO: 1394380 - protein, 9 aa, Homo Sapiens
AVGAERVLA

SEQ ID NO: 1394381 - protein, 9 aa, Homo Sapiens
NAKKKCHSS

SEQ ID NO: 1394382 - protein, 9 aa, Homo Sapiens
TLLPRAAPA

SEQ ID NO: 1394383 - protein, 9 aa, Homo Sapiens
YAQSRMHWR

SEQ ID NO: 1394384 - protein, 9 aa, Homo Sapiens
PGVCIFGYP

SEQ ID NO: 1394385 - protein, 9 aa, Homo Sapiens
NYLVDKHEK

SEQ ID NO: 1394386 - protein, 9 aa, Homo Sapiens
IMTCCTVFW

SEQ ID NO: 1394387 - protein, 9 aa, Homo Sapiens
IIAAVKIFP

SEQ ID NO: 1394388 - protein, 9 aa, Homo Sapiens
LASAPEVPA

SEQ ID NO: 1394389 - protein, 9 aa, Homo Sapiens
GGSSGGAGC

SEQ ID NO: 1394390 - protein, 9 aa, Homo Sapiens
ACGGLYNIC

SEQ ID NO: 1394391 - protein, 9 aa, Homo Sapiens
CPPLLEAFP

SEQ ID NO: 1394392 - protein, 9 aa, Homo Sapiens
WSLKNGLHT

SEQ ID NO: 1394393 - protein, 9 aa, Homo Sapiens
NLMSQEYSY

SEQ ID NO: 1394394 - protein, 9 aa, Homo Sapiens
TGASTRASG

SEQ ID NO: 1394395 - protein, 9 aa, Homo Sapiens
VPDEADSPR

SEQ ID NO: 1394396 - protein, 9 aa, Homo Sapiens
ACSCGVTGL

SEQ ID NO: 1394397 - protein, 9 aa, Homo Sapiens
IRLLVPTQY

SEQ ID NO: 1394398 - protein, 9 aa, Homo Sapiens
SSPKARVSF

SEQ ID NO: 1394399 - protein, 9 aa, Homo Sapiens
SDVSLHCSE

SEQ ID NO: 1394400 - protein, 9 aa, Homo Sapiens
LPKPAKSCR

SEQ ID NO: 1394401 - protein, 9 aa, Homo Sapiens
GSRGGTNGG

SEQ ID NO: 1394402 - protein, 9 aa, Homo Sapiens
ASCGCTLQY

SEQ ID NO: 1394403 - protein, 9 aa, Homo Sapiens
IPVTVLKSA

SEQ ID NO: 1394404 - protein, 9 aa, Homo Sapiens
ICDFGTTCD

SEQ ID NO: 1394405 - protein, 9 aa, Homo Sapiens
GTASHKSTS

SEQ ID NO: 1394406 - protein, 9 aa, Homo Sapiens
TRIACAHYP

SEQ ID NO: 1394407 - protein, 9 aa, Homo Sapiens
VTKGSVLWM

SEQ ID NO: 1394408 - protein, 9 aa, Homo Sapiens
PEWDCPLDS

SEQ ID NO: 1394409 - protein, 9 aa, Homo Sapiens
ELVNKTRWQ

SEQ ID NO: 1394410 - protein, 9 aa, Homo Sapiens
EVEHTVSEF

SEQ ID NO: 1394411 - protein, 9 aa, Homo Sapiens
VGSSFTVLR

SEQ ID NO: 1394412 - protein, 9 aa, Homo Sapiens
GRSFFSTPE

SEQ ID NO: 1394413 - protein, 9 aa, Homo Sapiens
FFLHKEFLL

SEQ ID NO: 1394414 - protein, 9 aa, Homo Sapiens
PQVPTSLPM

SEQ ID NO: 1394415 - protein, 9 aa, Homo Sapiens
TTGASEPRN

SEQ ID NO: 1394416 - protein, 9 aa, Homo Sapiens
ATPELRSSE

SEQ ID NO: 1394417 - protein, 9 aa, Homo Sapiens
WRRGSTARG

SEQ ID NO: 1394418 - protein, 9 aa, Homo Sapiens
SPLTEGPPR

SEQ ID NO: 1394419 - protein, 9 aa, Homo Sapiens
HLVQLLRQH

SEQ ID NO: 1394420 - protein, 9 aa, Homo Sapiens
DLRKALKFK

SEQ ID NO: 1394421 - protein, 9 aa, Homo Sapiens
GTCAARSQL

SEQ ID NO: 1394422 - protein, 9 aa, Homo Sapiens
SMYTQMPNT

SEQ ID NO: 1394423 - protein, 9 aa, Homo Sapiens
GKPWLLRYP

SEQ ID NO: 1394424 - protein, 9 aa, Homo Sapiens
SILSSTLWN

SEQ ID NO: 1394425 - protein, 9 aa, Homo Sapiens
LRDPSLQQT

SEQ ID NO: 1394426 - protein, 9 aa, Homo Sapiens
SQDPRLPAP

SEQ ID NO: 1394427 - protein, 9 aa, Homo Sapiens
GDPGDIGAE

SEQ ID NO: 1394428 - protein, 9 aa, Homo Sapiens
VMSLVIFVQ

SEQ ID NO: 1394429 - protein, 9 aa, Homo Sapiens
SLESSGYSI

SEQ ID NO: 1394430 - protein, 9 aa, Homo Sapiens
PLPKFTSLA

SEQ ID NO: 1394431 - protein, 9 aa, Homo Sapiens
LFFVLVNLE

SEQ ID NO: 1394432 - protein, 9 aa, Homo Sapiens
EDPLVQSLH

SEQ ID NO: 1394433 - protein, 9 aa, Homo Sapiens
PVGRLCCHH

SEQ ID NO: 1394434 - protein, 9 aa, Homo Sapiens
NDVGPVDAG

SEQ ID NO: 1394435 - protein, 9 aa, Homo Sapiens
VSDNDAGAL

SEQ ID NO: 1394436 - protein, 9 aa, Homo Sapiens
VDDARPPAE

SEQ ID NO: 1394437 - protein, 9 aa, Homo Sapiens
HFGSPSGGA

SEQ ID NO: 1394438 - protein, 9 aa, Homo Sapiens
PHRSPPTSC

SEQ ID NO: 1394439 - protein, 9 aa, Homo Sapiens
TEGVSPPFT

SEQ ID NO: 1394440 - protein, 9 aa, Homo Sapiens
LRFQGPAPP

SEQ ID NO: 1394441 - protein, 9 aa, Homo Sapiens
HPYYLPNLT

SEQ ID NO: 1394442 - protein, 9 aa, Homo Sapiens
SLGICVVKD

SEQ ID NO: 1394443 - protein, 9 aa, Homo Sapiens
GRVLARHDI

SEQ ID NO: 1394444 - protein, 9 aa, Homo Sapiens
PLLDCRSFF

SEQ ID NO: 1394445 - protein, 9 aa, Homo Sapiens
GCGGGNARR

SEQ ID NO: 1394446 - protein, 9 aa, Homo Sapiens
ENHKVYIWH

SEQ ID NO: 1394447 - protein, 9 aa, Homo Sapiens
KPPNPELPG

SEQ ID NO: 1394448 - protein, 9 aa, Homo Sapiens
VNTVTLAPN

SEQ ID NO: 1394449 - protein, 9 aa, Homo Sapiens
PFLPSMPGP

SEQ ID NO: 1394450 - protein, 9 aa, Homo Sapiens
NRYRSLVHT

SEQ ID NO: 1394451 - protein, 9 aa, Homo Sapiens
EVRLEASWQ

SEQ ID NO: 1394452 - protein, 9 aa, Homo Sapiens
VTTATQTLM

SEQ ID NO: 1394453 - protein, 9 aa, Homo Sapiens
AALQIPLTT

SEQ ID NO: 1394454 - protein, 9 aa, Homo Sapiens
AISTMVSSY

SEQ ID NO: 1394455 - protein, 9 aa, Homo Sapiens
LLITSSLSA

SEQ ID NO: 1394456 - protein, 9 aa, Homo Sapiens
SLRATVPRH

SEQ ID NO: 1394457 - protein, 9 aa, Homo Sapiens
VKVLQKGKK

SEQ ID NO: 1394458 - protein, 9 aa, Homo Sapiens
TLLYVNTVT

SEQ ID NO: 1394459 - protein, 9 aa, Homo Sapiens
VDKYGMVAP

SEQ ID NO: 1394460 - protein, 9 aa, Homo Sapiens
TTHKELQEL

SEQ ID NO: 1394461 - protein, 9 aa, Homo Sapiens
IHEVNMQGT

SEQ ID NO: 1394462 - protein, 9 aa, Homo Sapiens
HYMEMVKNL

SEQ ID NO: 1394463 - protein, 9 aa, Homo Sapiens
LWNFCLLPQ

SEQ ID NO: 1394464 - protein, 9 aa, Homo Sapiens
LQEKLVEEM

SEQ ID NO: 1394465 - protein, 9 aa, Homo Sapiens
RHHPRSRPG

SEQ ID NO: 1394466 - protein, 9 aa, Homo Sapiens
PTWLERQEA

SEQ ID NO: 1394467 - protein, 9 aa, Homo Sapiens
NVAIPANSE

SEQ ID NO: 1394468 - protein, 9 aa, Homo Sapiens
CTSLDAMVN

SEQ ID NO: 1394469 - protein, 9 aa, Homo Sapiens
VCDFIDNLD

SEQ ID NO: 1394470 - protein, 9 aa, Homo Sapiens
LSDERLCRS

SEQ ID NO: 1394471 - protein, 9 aa, Homo Sapiens
AQLCHKAQF

SEQ ID NO: 1394472 - protein, 9 aa, Homo Sapiens
TNGGSSGGA

SEQ ID NO: 1394473 - protein, 9 aa, Homo Sapiens
PRARPGTCA

SEQ ID NO: 1394474 - protein, 9 aa, Homo Sapiens
VLVLVLFLL

SEQ ID NO: 1394475 - protein, 9 aa, Homo Sapiens
FLMSHPRLC

SEQ ID NO: 1394476 - protein, 9 aa, Homo Sapiens
LVLILKIIR

SEQ ID NO: 1394477 - protein, 9 aa, Homo Sapiens
SSTDPTHTK

SEQ ID NO: 1394478 - protein, 9 aa, Homo Sapiens
LQSLVARGM

SEQ ID NO: 1394479 - protein, 9 aa, Homo Sapiens
AVLEYLTVE

SEQ ID NO: 1394480 - protein, 9 aa, Homo Sapiens
KTVIKKRDQ

SEQ ID NO: 1394481 - protein, 9 aa, Homo Sapiens
EWGCPFIET

SEQ ID NO: 1394482 - protein, 9 aa, Homo Sapiens
GLPRAWGRL

SEQ ID NO: 1394483 - protein, 9 aa, Homo Sapiens
DVIGKTDPN

SEQ ID NO: 1394484 - protein, 9 aa, Homo Sapiens
FLIIQTTGY

SEQ ID NO: 1394485 - protein, 9 aa, Homo Sapiens
KTSKRDGKI

SEQ ID NO: 1394486 - protein, 9 aa, Homo Sapiens
SSPVPPVLE

SEQ ID NO: 1394487 - protein, 9 aa, Homo Sapiens
AVRGTSPSQ

SEQ ID NO: 1394488 - protein, 9 aa, Homo Sapiens
ETTRMEDAT

SEQ ID NO: 1394489 - protein, 9 aa, Homo Sapiens
YGAETRKES

SEQ ID NO: 1394490 - protein, 9 aa, Homo Sapiens
LTHLLYYTE

SEQ ID NO: 1394491 - protein, 9 aa, Homo Sapiens
VGMTPRDLG

SEQ ID NO: 1394492 - protein, 9 aa, Homo Sapiens
QLLHGRWRL

SEQ ID NO: 1394493 - protein, 9 aa, Homo Sapiens
LEPQNQNFQ

SEQ ID NO: 1394494 - protein, 9 aa, Homo Sapiens
HPHGSPGPR

SEQ ID NO: 1394495 - protein, 9 aa, Homo Sapiens
VGWLQWRRV

SEQ ID NO: 1394496 - protein, 9 aa, Homo Sapiens
SIKRGPSQL

SEQ ID NO: 1394497 - protein, 9 aa, Homo Sapiens
TDPRHLVQL

SEQ ID NO: 1394498 - protein, 9 aa, Homo Sapiens
SGPTPVPTA

SEQ ID NO: 1394499 - protein, 9 aa, Homo Sapiens
STIVLLNST

SEQ ID NO: 1394500 - protein, 9 aa, Homo Sapiens
ATSPVTWLI

SEQ ID NO: 1394501 - protein, 9 aa, Homo Sapiens
ELLVNMGGN

SEQ ID NO: 1394502 - protein, 9 aa, Homo Sapiens
VIMGDGLYN

SEQ ID NO: 1394503 - protein, 9 aa, Homo Sapiens
SLIVTAASV

SEQ ID NO: 1394504 - protein, 9 aa, Homo Sapiens
DIDRERRAT

SEQ ID NO: 1394505 - protein, 9 aa, Homo Sapiens
WCRESLGGW

SEQ ID NO: 1394506 - protein, 9 aa, Homo Sapiens
GAGAQANLE

SEQ ID NO: 1394507 - protein, 9 aa, Homo Sapiens
EVNMQGTRN

SEQ ID NO: 1394508 - protein, 9 aa, Homo Sapiens
WLLQFFSQT

SEQ ID NO: 1394509 - protein, 9 aa, Homo Sapiens
HHQRSRRHR

SEQ ID NO: 1394510 - protein, 9 aa, Homo Sapiens
LRKERAQSA

SEQ ID NO: 1394511 - protein, 9 aa, Homo Sapiens
NGGHPEPLD

SEQ ID NO: 1394512 - protein, 9 aa, Homo Sapiens
SSPKPKAQT

SEQ ID NO: 1394513 - protein, 9 aa, Homo Sapiens
YLTVEILEL

SEQ ID NO: 1394514 - protein, 9 aa, Homo Sapiens
IEYSVGSTS

SEQ ID NO: 1394515 - protein, 9 aa, Homo Sapiens
PTLGQRPRQ

SEQ ID NO: 1394516 - protein, 9 aa, Homo Sapiens
GDKANFFQM

SEQ ID NO: 1394517 - protein, 9 aa, Homo Sapiens
QVAIVVKFF

SEQ ID NO: 1394518 - protein, 9 aa, Homo Sapiens
MGPVSPATT

SEQ ID NO: 1394519 - protein, 9 aa, Homo Sapiens
HRVKHKKEG

SEQ ID NO: 1394520 - protein, 9 aa, Homo Sapiens
YQVKTYHGG

SEQ ID NO: 1394521 - protein, 9 aa, Homo Sapiens
YKLQVPRIH

SEQ ID NO: 1394522 - protein, 9 aa, Homo Sapiens
QHGRRLLLP

SEQ ID NO: 1394523 - protein, 9 aa, Homo Sapiens
GRTSARRRT

SEQ ID NO: 1394524 - protein, 9 aa, Homo Sapiens
FSLRNCIPA

SEQ ID NO: 1394525 - protein, 9 aa, Homo Sapiens
NSVQQHRED

SEQ ID NO: 1394526 - protein, 9 aa, Homo Sapiens
AERLEAMEP

SEQ ID NO: 1394527 - protein, 9 aa, Homo Sapiens
SIKRKFHFE

SEQ ID NO: 1394528 - protein, 9 aa, Homo Sapiens
GFSRQVRVT

SEQ ID NO: 1394529 - protein, 9 aa, Homo Sapiens
PALLGSGGC

SEQ ID NO: 1394530 - protein, 9 aa, Homo Sapiens
PLTEGPPRT

SEQ ID NO: 1394531 - protein, 9 aa, Homo Sapiens
WKDLPATLC

SEQ ID NO: 1394532 - protein, 9 aa, Homo Sapiens
FWALILVTG

SEQ ID NO: 1394533 - protein, 9 aa, Homo Sapiens
VAHQITLLE

SEQ ID NO: 1394534 - protein, 9 aa, Homo Sapiens
LLLCLMVIV

SEQ ID NO: 1394535 - protein, 9 aa, Homo Sapiens
NLVAAGFLF

SEQ ID NO: 1394536 - protein, 9 aa, Homo Sapiens
SGEATHCKY

SEQ ID NO: 1394537 - protein, 9 aa, Homo Sapiens
GPPLSVPTI

SEQ ID NO: 1394538 - protein, 9 aa, Homo Sapiens
RRAPSCTAR

SEQ ID NO: 1394539 - protein, 9 aa, Homo Sapiens
SLVARGMGG

SEQ ID NO: 1394540 - protein, 9 aa, Homo Sapiens
PLASAPEVP

SEQ ID NO: 1394541 - protein, 9 aa, Homo Sapiens
SSLSLLASH

SEQ ID NO: 1394542 - protein, 9 aa, Homo Sapiens
PRIKCVWNK

SEQ ID NO: 1394543 - protein, 9 aa, Homo Sapiens
IHQASTASD

SEQ ID NO: 1394544 - protein, 9 aa, Homo Sapiens
FVSQAVIAD

SEQ ID NO: 1394545 - protein, 9 aa, Homo Sapiens
NGGSSGGAG

SEQ ID NO: 1394546 - protein, 9 aa, Homo Sapiens
KAAIKRQKY

SEQ ID NO: 1394547 - protein, 9 aa, Homo Sapiens
EPTLQLLRT

SEQ ID NO: 1394548 - protein, 9 aa, Homo Sapiens
LALGMPSMP

SEQ ID NO: 1394549 - protein, 9 aa, Homo Sapiens
FVTLLYVNT

SEQ ID NO: 1394550 - protein, 9 aa, Homo Sapiens
TTESSDTLC

SEQ ID NO: 1394551 - protein, 9 aa, Homo Sapiens
EQIPGLLGS

SEQ ID NO: 1394552 - protein, 9 aa, Homo Sapiens
PSAVPSVAR

SEQ ID NO: 1394553 - protein, 9 aa, Homo Sapiens
KDHRTSQNH

SEQ ID NO: 1394554 - protein, 9 aa, Homo Sapiens
QPLPGQHLW

SEQ ID NO: 1394555 - protein, 9 aa, Homo Sapiens
HTGCFPCGG

SEQ ID NO: 1394556 - protein, 9 aa, Homo Sapiens
SRSRGLPRA

SEQ ID NO: 1394557 - protein, 9 aa, Homo Sapiens
KTGSDMFVN

SEQ ID NO: 1394558 - protein, 9 aa, Homo Sapiens
VLTEKQEEA

SEQ ID NO: 1394559 - protein, 9 aa, Homo Sapiens
QGSIRQFVA

SEQ ID NO: 1394560 - protein, 9 aa, Homo Sapiens
GGAQLCKCR

SEQ ID NO: 1394561 - protein, 9 aa, Homo Sapiens
RRVWGAAAA

SEQ ID NO: 1394562 - protein, 9 aa, Homo Sapiens
KRLCQGRMF

SEQ ID NO: 1394563 - protein, 9 aa, Homo Sapiens
KARVSFWSV

SEQ ID NO: 1394564 - protein, 9 aa, Homo Sapiens
FWTPHSPDP

SEQ ID NO: 1394565 - protein, 9 aa, Homo Sapiens
LLPRAAPAP

SEQ ID NO: 1394566 - protein, 9 aa, Homo Sapiens
PYSESDSQA

SEQ ID NO: 1394567 - protein, 9 aa, Homo Sapiens
QEILPDEIY

SEQ ID NO: 1394568 - protein, 9 aa, Homo Sapiens
GPAARGMGG

SEQ ID NO: 1394569 - protein, 9 aa, Homo Sapiens
LNTTCLFCG

SEQ ID NO: 1394570 - protein, 9 aa, Homo Sapiens
LRPPAAVRE

SEQ ID NO: 1394571 - protein, 9 aa, Homo Sapiens
YHHRLIIYE

SEQ ID NO: 1394572 - protein, 9 aa, Homo Sapiens
LHNHYGGKE

SEQ ID NO: 1394573 - protein, 9 aa, Homo Sapiens
GHLGDGKKM

SEQ ID NO: 1394574 - protein, 9 aa, Homo Sapiens
VRRALHRQY

SEQ ID NO: 1394575 - protein, 9 aa, Homo Sapiens
MVAPHTLIR

SEQ ID NO: 1394576 - protein, 9 aa, Homo Sapiens
SILLTLLLT

SEQ ID NO: 1394577 - protein, 9 aa, Homo Sapiens
NPRTPPKIT

SEQ ID NO: 1394578 - protein, 9 aa, Homo Sapiens
ELDEVVAER

SEQ ID NO: 1394579 - protein, 9 aa, Homo Sapiens
EFRKIFETL

SEQ ID NO: 1394580 - protein, 9 aa, Homo Sapiens
QTGSLFKSR

SEQ ID NO: 1394581 - protein, 9 aa, Homo Sapiens
PKPSSSPKA

SEQ ID NO: 1394582 - protein, 9 aa, Homo Sapiens
LCQGRMFCS

SEQ ID NO: 1394583 - protein, 9 aa, Homo Sapiens
PVRLLLGVC

SEQ ID NO: 1394584 - protein, 9 aa, Homo Sapiens
SARSPTWCR

SEQ ID NO: 1394585 - protein, 9 aa, Homo Sapiens
PNMEGYRAP

SEQ ID NO: 1394586 - protein, 9 aa, Homo Sapiens
ASTYLIFCD

SEQ ID NO: 1394587 - protein, 9 aa, Homo Sapiens
SQGPRSCSE

SEQ ID NO: 1394588 - protein, 9 aa, Homo Sapiens
AGRRVWGAA

SEQ ID NO: 1394589 - protein, 9 aa, Homo Sapiens
LYRDMMLEN

SEQ ID NO: 1394590 - protein, 9 aa, Homo Sapiens
CDACVGMIA

SEQ ID NO: 1394591 - protein, 9 aa, Homo Sapiens
LYYGQEVLI

SEQ ID NO: 1394592 - protein, 9 aa, Homo Sapiens
DGRVLARHD

SEQ ID NO: 1394593 - protein, 9 aa, Homo Sapiens
QWGALYRLS

SEQ ID NO: 1394594 - protein, 9 aa, Homo Sapiens
FHVGSSFTV

SEQ ID NO: 1394595 - protein, 9 aa, Homo Sapiens
LDACSCGVT

SEQ ID NO: 1394596 - protein, 9 aa, Homo Sapiens
KYATLSLFY

SEQ ID NO: 1394597 - protein, 9 aa, Homo Sapiens
KISCTDSSV

SEQ ID NO: 1394598 - protein, 9 aa, Homo Sapiens
NEPAQREPP

SEQ ID NO: 1394599 - protein, 9 aa, Homo Sapiens
REELLKKCS

SEQ ID NO: 1394600 - protein, 9 aa, Homo Sapiens
RGHPSAFNN

SEQ ID NO: 1394601 - protein, 9 aa, Homo Sapiens
CVGSLINEQ

SEQ ID NO: 1394602 - protein, 9 aa, Homo Sapiens
AGMPGGLAG

SEQ ID NO: 1394603 - protein, 9 aa, Homo Sapiens
FVICWLPFL

SEQ ID NO: 1394604 - protein, 9 aa, Homo Sapiens
DRALQASYT

SEQ ID NO: 1394605 - protein, 9 aa, Homo Sapiens
KRPRFQMLP

SEQ ID NO: 1394606 - protein, 9 aa, Homo Sapiens
HQWNPPLVV

SEQ ID NO: 1394607 - protein, 9 aa, Homo Sapiens
VDAGFLSRP

SEQ ID NO: 1394608 - protein, 9 aa, Homo Sapiens
TTSRCCPPG

SEQ ID NO: 1394609 - protein, 9 aa, Homo Sapiens
AHYYQLQPM

SEQ ID NO: 1394610 - protein, 9 aa, Homo Sapiens
FSLFSVMSL

SEQ ID NO: 1394611 - protein, 9 aa, Homo Sapiens
SAGPPAGAF

SEQ ID NO: 1394612 - protein, 9 aa, Homo Sapiens
GGAEGGGGQ

SEQ ID NO: 1394613 - protein, 9 aa, Homo Sapiens
QSVFSAPAC

SEQ ID NO: 1394614 - protein, 9 aa, Homo Sapiens
PAVGARRRP

SEQ ID NO: 1394615 - protein, 9 aa, Homo Sapiens
LLFEKAAPR

SEQ ID NO: 1394616 - protein, 9 aa, Homo Sapiens
PDDVCDFID

SEQ ID NO: 1394617 - protein, 9 aa, Homo Sapiens
VAIPANSED

SEQ ID NO: 1394618 - protein, 9 aa, Homo Sapiens
NLNGNSVTT

SEQ ID NO: 1394619 - protein, 9 aa, Homo Sapiens
AHAMRERIR

SEQ ID NO: 1394620 - protein, 9 aa, Homo Sapiens
VTVTVLSQK

SEQ ID NO: 1394621 - protein, 9 aa, Homo Sapiens
KGFFRCSIR

SEQ ID NO: 1394622 - protein, 9 aa, Homo Sapiens
ISSCLGHGG

SEQ ID NO: 1394623 - protein, 9 aa, Homo Sapiens
NLNWKFSGV

SEQ ID NO: 1394624 - protein, 9 aa, Homo Sapiens
TFFFLHKEF

SEQ ID NO: 1394625 - protein, 9 aa, Homo Sapiens
PTPVPTATA

SEQ ID NO: 1394626 - protein, 9 aa, Homo Sapiens
VKFFLQLQG

SEQ ID NO: 1394627 - protein, 9 aa, Homo Sapiens
PPPPTPASG

SEQ ID NO: 1394628 - protein, 9 aa, Homo Sapiens
LLVPKRISI

SEQ ID NO: 1394629 - protein, 9 aa, Homo Sapiens
AVGARKQEE

SEQ ID NO: 1394630 - protein, 9 aa, Homo Sapiens
AKSGGEEAA

SEQ ID NO: 1394631 - protein, 9 aa, Homo Sapiens
CVGMIAECP

SEQ ID NO: 1394632 - protein, 9 aa, Homo Sapiens
GIRPGVAYR

SEQ ID NO: 1394633 - protein, 9 aa, Homo Sapiens
KAAPRPCWS

SEQ ID NO: 1394634 - protein, 9 aa, Homo Sapiens
CWLLQFFSQ

SEQ ID NO: 1394635 - protein, 9 aa, Homo Sapiens
LQINKPTPN

SEQ ID NO: 1394636 - protein, 9 aa, Homo Sapiens
MDVMCYTAS

SEQ ID NO: 1394637 - protein, 9 aa, Homo Sapiens
KAHPCPLPP

SEQ ID NO: 1394638 - protein, 9 aa, Homo Sapiens
LASSLLCSG

SEQ ID NO: 1394639 - protein, 9 aa, Homo Sapiens
IHYINPRTP

SEQ ID NO: 1394640 - protein, 9 aa, Homo Sapiens
EDASDVLQA

SEQ ID NO: 1394641 - protein, 9 aa, Homo Sapiens
GTMFTNSGN

SEQ ID NO: 1394642 - protein, 9 aa, Homo Sapiens
IMISALVAL

SEQ ID NO: 1394643 - protein, 9 aa, Homo Sapiens
ATVPRHSSV

SEQ ID NO: 1394644 - protein, 9 aa, Homo Sapiens
IEDISEADL

SEQ ID NO: 1394645 - protein, 9 aa, Homo Sapiens
CHHWNKVLC

SEQ ID NO: 1394646 - protein, 9 aa, Homo Sapiens
VVTRVWHPA

SEQ ID NO: 1394647 - protein, 9 aa, Homo Sapiens
DRYRGPPGP

SEQ ID NO: 1394648 - protein, 9 aa, Homo Sapiens
QTVQQHGRR

SEQ ID NO: 1394649 - protein, 9 aa, Homo Sapiens
TGGGSVPWR

SEQ ID NO: 1394650 - protein, 9 aa, Homo Sapiens
IIMVLFADQ

SEQ ID NO: 1394651 - protein, 9 aa, Homo Sapiens
PSSHRVLVA

SEQ ID NO: 1394652 - protein, 9 aa, Homo Sapiens
GICVVKDLS

SEQ ID NO: 1394653 - protein, 9 aa, Homo Sapiens
GHKKVTAVH

SEQ ID NO: 1394654 - protein, 9 aa, Homo Sapiens
PENGPETSD

SEQ ID NO: 1394655 - protein, 9 aa, Homo Sapiens
LWMSPASSP

SEQ ID NO: 1394656 - protein, 9 aa, Homo Sapiens
QAVGARKQE

SEQ ID NO: 1394657 - protein, 9 aa, Homo Sapiens
TAPLRPLSG

SEQ ID NO: 1394658 - protein, 9 aa, Homo Sapiens
ELLVPKRIS

SEQ ID NO: 1394659 - protein, 9 aa, Homo Sapiens
QLQGLVAGV

SEQ ID NO: 1394660 - protein, 9 aa, Homo Sapiens
TTRMEDATE

SEQ ID NO: 1394661 - protein, 9 aa, Homo Sapiens
EVVKMHVKQ

SEQ ID NO: 1394662 - protein, 9 aa, Homo Sapiens
ALSRASFNY

SEQ ID NO: 1394663 - protein, 9 aa, Homo Sapiens
SYTNPAVTA

SEQ ID NO: 1394664 - protein, 9 aa, Homo Sapiens
AQLCKCRRP

SEQ ID NO: 1394665 - protein, 9 aa, Homo Sapiens
KTYHGGGAP

SEQ ID NO: 1394666 - protein, 9 aa, Homo Sapiens
RPPPLVRCH

SEQ ID NO: 1394667 - protein, 9 aa, Homo Sapiens
PTPEASGGA

SEQ ID NO: 1394668 - protein, 9 aa, Homo Sapiens
PQTPYCISI

SEQ ID NO: 1394669 - protein, 9 aa, Homo Sapiens
SVALRDNHL

SEQ ID NO: 1394670 - protein, 9 aa, Homo Sapiens
VGAERVLAY

SEQ ID NO: 1394671 - protein, 9 aa, Homo Sapiens
TLPWTLRKQ

SEQ ID NO: 1394672 - protein, 9 aa, Homo Sapiens
IHQLATSSQ

SEQ ID NO: 1394673 - protein, 9 aa, Homo Sapiens
LVKNHDHPD

SEQ ID NO: 1394674 - protein, 9 aa, Homo Sapiens
SGRASRKTW

SEQ ID NO: 1394675 - protein, 9 aa, Homo Sapiens
HGTSNWKKP

SEQ ID NO: 1394676 - protein, 9 aa, Homo Sapiens
SFELISFKA

SEQ ID NO: 1394677 - protein, 9 aa, Homo Sapiens
GTQTVLGPS

SEQ ID NO: 1394678 - protein, 9 aa, Homo Sapiens
HHSRPVFDL

SEQ ID NO: 1394679 - protein, 9 aa, Homo Sapiens
GNSQGTVFP

SEQ ID NO: 1394680 - protein, 9 aa, Homo Sapiens
HIHAKGSYE

SEQ ID NO: 1394681 - protein, 9 aa, Homo Sapiens
KLKRAVEKV

SEQ ID NO: 1394682 - protein, 9 aa, Homo Sapiens
LQAAWPRGE

SEQ ID NO: 1394683 - protein, 9 aa, Homo Sapiens
SCHIRAGPN

SEQ ID NO: 1394684 - protein, 9 aa, Homo Sapiens
SDSQASRER

SEQ ID NO: 1394685 - protein, 9 aa, Homo Sapiens
CLICCGYIP

SEQ ID NO: 1394686 - protein, 9 aa, Homo Sapiens
FWGVPRKMI

SEQ ID NO: 1394687 - protein, 9 aa, Homo Sapiens
ADPPAQPAL

SEQ ID NO: 1394688 - protein, 9 aa, Homo Sapiens
QVGITLLPR

SEQ ID NO: 1394689 - protein, 9 aa, Homo Sapiens
TIHNSVKNS

SEQ ID NO: 1394690 - protein, 9 aa, Homo Sapiens
LHRQISLPL

SEQ ID NO: 1394691 - protein, 9 aa, Homo Sapiens
QGTVFPLCP

SEQ ID NO: 1394692 - protein, 9 aa, Homo Sapiens
IKLKRAVEK

SEQ ID NO: 1394693 - protein, 9 aa, Homo Sapiens
GKEHVNPEY

SEQ ID NO: 1394694 - protein, 9 aa, Homo Sapiens
MIRTLNADL

SEQ ID NO: 1394695 - protein, 9 aa, Homo Sapiens
IYGKCFPFQ

SEQ ID NO: 1394696 - protein, 9 aa, Homo Sapiens
ASTIVLLNS

SEQ ID NO: 1394697 - protein, 9 aa, Homo Sapiens
PGWQRLDQE

SEQ ID NO: 1394698 - protein, 9 aa, Homo Sapiens
CHLASGRGC

SEQ ID NO: 1394699 - protein, 9 aa, Homo Sapiens
MHACGGAGG

SEQ ID NO: 1394700 - protein, 9 aa, Homo Sapiens
RPSTTRRDS

SEQ ID NO: 1394701 - protein, 9 aa, Homo Sapiens
YKIPEGFQD

SEQ ID NO: 1394702 - protein, 9 aa, Homo Sapiens
RWTEASLRR

SEQ ID NO: 1394703 - protein, 9 aa, Homo Sapiens
PLPKCRVPA

SEQ ID NO: 1394704 - protein, 9 aa, Homo Sapiens
NPEQAVGAR

SEQ ID NO: 1394705 - protein, 9 aa, Homo Sapiens
RSEALYAFL

SEQ ID NO: 1394706 - protein, 9 aa, Homo Sapiens
RRIGATTPP

SEQ ID NO: 1394707 - protein, 9 aa, Homo Sapiens
FAASQVVVM

SEQ ID NO: 1394708 - protein, 9 aa, Homo Sapiens
VLVLFLLLW

SEQ ID NO: 1394709 - protein, 9 aa, Homo Sapiens
LVALTRIAC

SEQ ID NO: 1394710 - protein, 9 aa, Homo Sapiens
FKSRKAYLP

SEQ ID NO: 1394711 - protein, 9 aa, Homo Sapiens
GPEERGRTQ

SEQ ID NO: 1394712 - protein, 9 aa, Homo Sapiens
AQALLAGSR

SEQ ID NO: 1394713 - protein, 9 aa, Homo Sapiens
PSAECSVLP

SEQ ID NO: 1394714 - protein, 9 aa, Homo Sapiens
PPNTKDRLI

SEQ ID NO: 1394715 - protein, 9 aa, Homo Sapiens
SLDRNLGSP

SEQ ID NO: 1394716 - protein, 9 aa, Homo Sapiens
GASGWSASC

SEQ ID NO: 1394717 - protein, 9 aa, Homo Sapiens
VTVLSQKLC

SEQ ID NO: 1394718 - protein, 9 aa, Homo Sapiens
HEWNDGRDP

SEQ ID NO: 1394719 - protein, 9 aa, Homo Sapiens
TCDIQTHMT

SEQ ID NO: 1394720 - protein, 9 aa, Homo Sapiens
AVAGMPGGL

SEQ ID NO: 1394721 - protein, 9 aa, Homo Sapiens
AAAAPTGAA

SEQ ID NO: 1394722 - protein, 9 aa, Homo Sapiens
GGHAQPEAA

SEQ ID NO: 1394723 - protein, 9 aa, Homo Sapiens
RSLLCPGHV

SEQ ID NO: 1394724 - protein, 9 aa, Homo Sapiens
MEKSELVNK

SEQ ID NO: 1394725 - protein, 9 aa, Homo Sapiens
CRAGGPAGW

SEQ ID NO: 1394726 - protein, 9 aa, Homo Sapiens
KSFVDNFVS

SEQ ID NO: 1394727 - protein, 9 aa, Homo Sapiens
LRYPSLLEQ

SEQ ID NO: 1394728 - protein, 9 aa, Homo Sapiens
STMLPVQYF

SEQ ID NO: 1394729 - protein, 9 aa, Homo Sapiens
NLCKNELET

SEQ ID NO: 1394730 - protein, 9 aa, Homo Sapiens
DDLDVGDCP

SEQ ID NO: 1394731 - protein, 9 aa, Homo Sapiens
EDILSLLSQ

SEQ ID NO: 1394732 - protein, 9 aa, Homo Sapiens
VGHGHEAET

SEQ ID NO: 1394733 - protein, 9 aa, Homo Sapiens
TSDNGGHPE

SEQ ID NO: 1394734 - protein, 9 aa, Homo Sapiens
WLQWRRVSA

SEQ ID NO: 1394735 - protein, 9 aa, Homo Sapiens
CTDSSVNFL

SEQ ID NO: 1394736 - protein, 9 aa, Homo Sapiens
NAHITCRLY

SEQ ID NO: 1394737 - protein, 9 aa, Homo Sapiens
TWRRTGAST

SEQ ID NO: 1394738 - protein, 9 aa, Homo Sapiens
GGAHPTPPM

SEQ ID NO: 1394739 - protein, 9 aa, Homo Sapiens
VSPPFTARV

SEQ ID NO: 1394740 - protein, 9 aa, Homo Sapiens
RPKPSSSPK

SEQ ID NO: 1394741 - protein, 9 aa, Homo Sapiens
TVSEFIKYE

SEQ ID NO: 1394742 - protein, 9 aa, Homo Sapiens
LPEYKLQVP

SEQ ID NO: 1394743 - protein, 9 aa, Homo Sapiens
WPASTCPLP

SEQ ID NO: 1394744 - protein, 9 aa, Homo Sapiens
VSMKSISAA

SEQ ID NO: 1394745 - protein, 9 aa, Homo Sapiens
GVMVARCKR

SEQ ID NO: 1394746 - protein, 9 aa, Homo Sapiens
NSQVCPEQF

SEQ ID NO: 1394747 - protein, 9 aa, Homo Sapiens
PEPAPAASM

SEQ ID NO: 1394748 - protein, 9 aa, Homo Sapiens
IVIVLYFSL

SEQ ID NO: 1394749 - protein, 9 aa, Homo Sapiens
LPDDVCDFI

SEQ ID NO: 1394750 - protein, 9 aa, Homo Sapiens
MPGPKKAKG

SEQ ID NO: 1394751 - protein, 9 aa, Homo Sapiens
PLQTVANIS

SEQ ID NO: 1394752 - protein, 9 aa, Homo Sapiens
IPGLLGSPL

SEQ ID NO: 1394753 - protein, 9 aa, Homo Sapiens
KICSLLILI

SEQ ID NO: 1394754 - protein, 9 aa, Homo Sapiens
FRRTHVYIA

SEQ ID NO: 1394755 - protein, 9 aa, Homo Sapiens
IPLQTVANI

SEQ ID NO: 1394756 - protein, 9 aa, Homo Sapiens
TGWSTRGRS

SEQ ID NO: 1394757 - protein, 9 aa, Homo Sapiens
QCTFFFLHK

SEQ ID NO: 1394758 - protein, 9 aa, Homo Sapiens
YQQILHQNL

SEQ ID NO: 1394759 - protein, 9 aa, Homo Sapiens
ETFNGESSW

SEQ ID NO: 1394760 - protein, 9 aa, Homo Sapiens
LWMATMRTQ

SEQ ID NO: 1394761 - protein, 9 aa, Homo Sapiens
EQMSVIWDK

SEQ ID NO: 1394762 - protein, 9 aa, Homo Sapiens
PPAEEEEEG

SEQ ID NO: 1394763 - protein, 9 aa, Homo Sapiens
LCRSEALYA

SEQ ID NO: 1394764 - protein, 9 aa, Homo Sapiens
WRWSPCSAA

SEQ ID NO: 1394765 - protein, 9 aa, Homo Sapiens
YLPNLTHLA

SEQ ID NO: 1394766 - protein, 9 aa, Homo Sapiens
TLNQRVQMV

SEQ ID NO: 1394767 - protein, 9 aa, Homo Sapiens
WGAAAAAPT

SEQ ID NO: 1394768 - protein, 9 aa, Homo Sapiens
PSLAFSVTT

SEQ ID NO: 1394769 - protein, 9 aa, Homo Sapiens
SFFFCLRGH

SEQ ID NO: 1394770 - protein, 9 aa, Homo Sapiens
QTMNSFLVA

SEQ ID NO: 1394771 - protein, 9 aa, Homo Sapiens
GAQLCKCRR

SEQ ID NO: 1394772 - protein, 9 aa, Homo Sapiens
EYSYPLPKF

SEQ ID NO: 1394773 - protein, 9 aa, Homo Sapiens
SLRKERAQS

SEQ ID NO: 1394774 - protein, 9 aa, Homo Sapiens
ARSPTSAPT

SEQ ID NO: 1394775 - protein, 9 aa, Homo Sapiens
VNARTAVIR

SEQ ID NO: 1394776 - protein, 9 aa, Homo Sapiens
MGDGLYNFS

SEQ ID NO: 1394777 - protein, 9 aa, Homo Sapiens
PPGHPCSRR

SEQ ID NO: 1394778 - protein, 9 aa, Homo Sapiens
LRKPRRRRG

SEQ ID NO: 1394779 - protein, 9 aa, Homo Sapiens
TWMRPKKCP

SEQ ID NO: 1394780 - protein, 9 aa, Homo Sapiens
SPSSCNPPA

SEQ ID NO: 1394781 - protein, 9 aa, Homo Sapiens
LNWTFLEHF

SEQ ID NO: 1394782 - protein, 9 aa, Homo Sapiens
LQEVLFHVG

SEQ ID NO: 1394783 - protein, 9 aa, Homo Sapiens
VDNDLDSFS

SEQ ID NO: 1394784 - protein, 9 aa, Homo Sapiens
PRSSPKPKA

SEQ ID NO: 1394785 - protein, 9 aa, Homo Sapiens
GPEWDCPLD

SEQ ID NO: 1394786 - protein, 9 aa, Homo Sapiens
NNWLCTSWV

SEQ ID NO: 1394787 - protein, 9 aa, Homo Sapiens
QLTRLMRRN

SEQ ID NO: 1394788 - protein, 9 aa, Homo Sapiens
PNPELPGVD

SEQ ID NO: 1394789 - protein, 9 aa, Homo Sapiens
PAWDERLPS

SEQ ID NO: 1394790 - protein, 9 aa, Homo Sapiens
CVTSAPNGT

SEQ ID NO: 1394791 - protein, 9 aa, Homo Sapiens
SLPLRGFLL

SEQ ID NO: 1394792 - protein, 9 aa, Homo Sapiens
IKRKFHFEE

SEQ ID NO: 1394793 - protein, 9 aa, Homo Sapiens
YKSIIIVHQ

SEQ ID NO: 1394794 - protein, 9 aa, Homo Sapiens
RSGVLTEKQ

SEQ ID NO: 1394795 - protein, 9 aa, Homo Sapiens
LLLWRLFLI

SEQ ID NO: 1394796 - protein, 9 aa, Homo Sapiens
GMVAPHTLI

SEQ ID NO: 1394797 - protein, 9 aa, Homo Sapiens
NKKRKKMFL

SEQ ID NO: 1394798 - protein, 9 aa, Homo Sapiens
RQVRVTVLL

SEQ ID NO: 1394799 - protein, 9 aa, Homo Sapiens
SPLPSSTGK

SEQ ID NO: 1394800 - protein, 9 aa, Homo Sapiens
TRFWRWSPC

SEQ ID NO: 1394801 - protein, 9 aa, Homo Sapiens
SLWGPQTIL

SEQ ID NO: 1394802 - protein, 9 aa, Homo Sapiens
SPSVLLSSV

SEQ ID NO: 1394803 - protein, 9 aa, Homo Sapiens
NHDVGSELP

SEQ ID NO: 1394804 - protein, 9 aa, Homo Sapiens
QAQVYFTQE

SEQ ID NO: 1394805 - protein, 9 aa, Homo Sapiens
FRCEIYGKC

SEQ ID NO: 1394806 - protein, 9 aa, Homo Sapiens
AELFVLSYQ

SEQ ID NO: 1394807 - protein, 9 aa, Homo Sapiens
AACRWPSLE

SEQ ID NO: 1394808 - protein, 9 aa, Homo Sapiens
LRFQMIRTL

SEQ ID NO: 1394809 - protein, 9 aa, Homo Sapiens
ALLGSGGCH

SEQ ID NO: 1394810 - protein, 9 aa, Homo Sapiens
SLRCTPQPR

SEQ ID NO: 1394811 - protein, 9 aa, Homo Sapiens
ATLEPQNQN

SEQ ID NO: 1394812 - protein, 9 aa, Homo Sapiens
SSEPKEEEE

SEQ ID NO: 1394813 - protein, 9 aa, Homo Sapiens
KGDPGQPGP

SEQ ID NO: 1394814 - protein, 9 aa, Homo Sapiens
NGPETSDPS

SEQ ID NO: 1394815 - protein, 9 aa, Homo Sapiens
LRSWQLDAN

SEQ ID NO: 1394816 - protein, 9 aa, Homo Sapiens
SIKVSVELL

SEQ ID NO: 1394817 - protein, 9 aa, Homo Sapiens
FSQTYMHPM

SEQ ID NO: 1394818 - protein, 9 aa, Homo Sapiens
HLHRQISLP

SEQ ID NO: 1394819 - protein, 9 aa, Homo Sapiens
PLQDGSLDR

SEQ ID NO: 1394820 - protein, 9 aa, Homo Sapiens
VPVLSSTML

SEQ ID NO: 1394821 - protein, 9 aa, Homo Sapiens
GAFNDNEKE

SEQ ID NO: 1394822 - protein, 9 aa, Homo Sapiens
CPLLLVYIM

SEQ ID NO: 1394823 - protein, 9 aa, Homo Sapiens
QVLTYEWRL

SEQ ID NO: 1394824 - protein, 9 aa, Homo Sapiens
KVIPQKPNK

SEQ ID NO: 1394825 - protein, 9 aa, Homo Sapiens
CVPTAARPS

SEQ ID NO: 1394826 - protein, 9 aa, Homo Sapiens
TVLSQKLCN

SEQ ID NO: 1394827 - protein, 9 aa, Homo Sapiens
PFVSQAVIA

SEQ ID NO: 1394828 - protein, 9 aa, Homo Sapiens
PSLLEQQIL

SEQ ID NO: 1394829 - protein, 9 aa, Homo Sapiens
RPPAEEEEE

SEQ ID NO: 1394830 - protein, 9 aa, Homo Sapiens
VSPATTRRA

SEQ ID NO: 1394831 - protein, 9 aa, Homo Sapiens
RIKCVWNKN

SEQ ID NO: 1394832 - protein, 9 aa, Homo Sapiens
TSVSRHSSS

SEQ ID NO: 1394833 - protein, 9 aa, Homo Sapiens
AVEKVKKLL

SEQ ID NO: 1394834 - protein, 9 aa, Homo Sapiens
FTSRVQKNL

SEQ ID NO: 1394835 - protein, 9 aa, Homo Sapiens
SHPPTTTTS

SEQ ID NO: 1394836 - protein, 9 aa, Homo Sapiens
YRDMMLENY

SEQ ID NO: 1394837 - protein, 9 aa, Homo Sapiens
VARCKREHS

SEQ ID NO: 1394838 - protein, 9 aa, Homo Sapiens
VIEYSVGST

SEQ ID NO: 1394839 - protein, 9 aa, Homo Sapiens
AASMRPDGR

SEQ ID NO: 1394840 - protein, 9 aa, Homo Sapiens
WSLLNWTFL

SEQ ID NO: 1394841 - protein, 9 aa, Homo Sapiens
ELRSSENSA

SEQ ID NO: 1394842 - protein, 9 aa, Homo Sapiens
ETIVLQHEY

SEQ ID NO: 1394843 - protein, 9 aa, Homo Sapiens
MASAQPTAI

SEQ ID NO: 1394844 - protein, 9 aa, Homo Sapiens
GWAALLLYY

SEQ ID NO: 1394845 - protein, 9 aa, Homo Sapiens
FVNISRVEL

SEQ ID NO: 1394846 - protein, 9 aa, Homo Sapiens
DAKEVEHTV

SEQ ID NO: 1394847 - protein, 9 aa, Homo Sapiens
GHGHEAETL

SEQ ID NO: 1394848 - protein, 9 aa, Homo Sapiens
TLDACSCGV

SEQ ID NO: 1394849 - protein, 9 aa, Homo Sapiens
LSQYPWKEY

SEQ ID NO: 1394850 - protein, 9 aa, Homo Sapiens
PQCTFFFLH

SEQ ID NO: 1394851 - protein, 9 aa, Homo Sapiens
NFWGVPRKM

SEQ ID NO: 1394852 - protein, 9 aa, Homo Sapiens
HRQISLPLR

SEQ ID NO: 1394853 - protein, 9 aa, Homo Sapiens
ASGRASRKT

SEQ ID NO: 1394854 - protein, 9 aa, Homo Sapiens
HPTPPMPTR

SEQ ID NO: 1394855 - protein, 9 aa, Homo Sapiens
AGKPWLLRY

SEQ ID NO: 1394856 - protein, 9 aa, Homo Sapiens
LCKCRRPRG

SEQ ID NO: 1394857 - protein, 9 aa, Homo Sapiens
ACLLGPVLL

SEQ ID NO: 1394858 - protein, 9 aa, Homo Sapiens
LCPWLPQGH

SEQ ID NO: 1394859 - protein, 9 aa, Homo Sapiens
DEAFYHHRL

SEQ ID NO: 1394860 - protein, 9 aa, Homo Sapiens
RWTAPLRPL

SEQ ID NO: 1394861 - protein, 9 aa, Homo Sapiens
ISFKAALRS

SEQ ID NO: 1394862 - protein, 9 aa, Homo Sapiens
SCAVNKGQP

SEQ ID NO: 1394863 - protein, 9 aa, Homo Sapiens
PCFLELRQG

SEQ ID NO: 1394864 - protein, 9 aa, Homo Sapiens
KTIHEVNMQ

SEQ ID NO: 1394865 - protein, 9 aa, Homo Sapiens
FVRRALHRQ

SEQ ID NO: 1394866 - protein, 9 aa, Homo Sapiens
SIIGSPSVA

SEQ ID NO: 1394867 - protein, 9 aa, Homo Sapiens
KLQVPRIHR

SEQ ID NO: 1394868 - protein, 9 aa, Homo Sapiens
DAQLYKGIE

SEQ ID NO: 1394869 - protein, 9 aa, Homo Sapiens
AEERDQKRE

SEQ ID NO: 1394870 - protein, 9 aa, Homo Sapiens
VLHRLLQEQ

SEQ ID NO: 1394871 - protein, 9 aa, Homo Sapiens
PTLQLLRTF

SEQ ID NO: 1394872 - protein, 9 aa, Homo Sapiens
DNDLDSFSE

SEQ ID NO: 1394873 - protein, 9 aa, Homo Sapiens
PASGRASRK

SEQ ID NO: 1394874 - protein, 9 aa, Homo Sapiens
QSAEEPWTQ

SEQ ID NO: 1394875 - protein, 9 aa, Homo Sapiens
ERLCRSEAL

SEQ ID NO: 1394876 - protein, 9 aa, Homo Sapiens
VHKVCVKEI

SEQ ID NO: 1394877 - protein, 9 aa, Homo Sapiens
RMRARLQSQ

SEQ ID NO: 1394878 - protein, 9 aa, Homo Sapiens
PSLRSSWNR

SEQ ID NO: 1394879 - protein, 9 aa, Homo Sapiens
SCSTLKVAT

SEQ ID NO: 1394880 - protein, 9 aa, Homo Sapiens
APTGAAGAA

SEQ ID NO: 1394881 - protein, 9 aa, Homo Sapiens
CRTGASTRA

SEQ ID NO: 1394882 - protein, 9 aa, Homo Sapiens
EAFYHHRLI

SEQ ID NO: 1394883 - protein, 9 aa, Homo Sapiens
SNNSSESHI

SEQ ID NO: 1394884 - protein, 9 aa, Homo Sapiens
ETARTMLCF

SEQ ID NO: 1394885 - protein, 9 aa, Homo Sapiens
PPTLGQRPR

SEQ ID NO: 1394886 - protein, 9 aa, Homo Sapiens
YSGPPPRAR

SEQ ID NO: 1394887 - protein, 9 aa, Homo Sapiens
FELISFKAA

SEQ ID NO: 1394888 - protein, 9 aa, Homo Sapiens
EDGLEQDLQ

SEQ ID NO: 1394889 - protein, 9 aa, Homo Sapiens
CSHFSRCSW

SEQ ID NO: 1394890 - protein, 9 aa, Homo Sapiens
GVPRKMILS

SEQ ID NO: 1394891 - protein, 9 aa, Homo Sapiens
SEADLVRPL

SEQ ID NO: 1394892 - protein, 9 aa, Homo Sapiens
RVRVGVQTV

SEQ ID NO: 1394893 - protein, 9 aa, Homo Sapiens
PPRSSPKPK

SEQ ID NO: 1394894 - protein, 9 aa, Homo Sapiens
KTVDYHRLD

SEQ ID NO: 1394895 - protein, 9 aa, Homo Sapiens
PSPSVLLSS

SEQ ID NO: 1394896 - protein, 9 aa, Homo Sapiens
SLRSSWNRL

SEQ ID NO: 1394897 - protein, 9 aa, Homo Sapiens
AAAPTGAAG

SEQ ID NO: 1394898 - protein, 9 aa, Homo Sapiens
SASCGCTLQ

SEQ ID NO: 1394899 - protein, 9 aa, Homo Sapiens
DEEVCGTGV

SEQ ID NO: 1394900 - protein, 9 aa, Homo Sapiens
TTMKRPFLW

SEQ ID NO: 1394901 - protein, 9 aa, Homo Sapiens
QLPQHALVC

SEQ ID NO: 1394902 - protein, 9 aa, Homo Sapiens
KISSWQVLF

SEQ ID NO: 1394903 - protein, 9 aa, Homo Sapiens
FIASGSENH

SEQ ID NO: 1394904 - protein, 9 aa, Homo Sapiens
GRGCLLPVW

SEQ ID NO: 1394905 - protein, 9 aa, Homo Sapiens
NRQNKKVVE

SEQ ID NO: 1394906 - protein, 9 aa, Homo Sapiens
FLSPQWATI

SEQ ID NO: 1394907 - protein, 9 aa, Homo Sapiens
ELISFKAAL

SEQ ID NO: 1394908 - protein, 9 aa, Homo Sapiens
SPAPPPELT

SEQ ID NO: 1394909 - protein, 9 aa, Homo Sapiens
DDARPPAEE

SEQ ID NO: 1394910 - protein, 9 aa, Homo Sapiens
NGTEEQMSV

SEQ ID NO: 1394911 - protein, 9 aa, Homo Sapiens
LLNWTFLEH

SEQ ID NO: 1394912 - protein, 9 aa, Homo Sapiens
IIAALYEMP

SEQ ID NO: 1394913 - protein, 9 aa, Homo Sapiens
MGHGGTHAF

SEQ ID NO: 1394914 - protein, 9 aa, Homo Sapiens
AFSSKVVHI

SEQ ID NO: 1394915 - protein, 9 aa, Homo Sapiens
TSGSTPGSG

SEQ ID NO: 1394916 - protein, 9 aa, Homo Sapiens
NLGSPLMSE

SEQ ID NO: 1394917 - protein, 9 aa, Homo Sapiens
LRCTPQPRP

SEQ ID NO: 1394918 - protein, 9 aa, Homo Sapiens
SPAKAEQRF

SEQ ID NO: 1394919 - protein, 9 aa, Homo Sapiens
EGVSPPFTA

SEQ ID NO: 1394920 - protein, 9 aa, Homo Sapiens
PGGLAGAMN

SEQ ID NO: 1394921 - protein, 9 aa, Homo Sapiens
RFAAYIFGL

SEQ ID NO: 1394922 - protein, 9 aa, Homo Sapiens
NTSAGRYVC

SEQ ID NO: 1394923 - protein, 9 aa, Homo Sapiens
NLKELRERE

SEQ ID NO: 1394924 - protein, 9 aa, Homo Sapiens
SVTKGSVLW

SEQ ID NO: 1394925 - protein, 9 aa, Homo Sapiens
LPTISRGEQ

SEQ ID NO: 1394926 - protein, 9 aa, Homo Sapiens
VHIMTCCTV

SEQ ID NO: 1394927 - protein, 9 aa, Homo Sapiens
KSGCVFIIK

SEQ ID NO: 1394928 - protein, 9 aa, Homo Sapiens
RQGLTFPGW

SEQ ID NO: 1394929 - protein, 9 aa, Homo Sapiens
RVWHPAIPA

SEQ ID NO: 1394930 - protein, 9 aa, Homo Sapiens
IPKKAFCEP

SEQ ID NO: 1394931 - protein, 9 aa, Homo Sapiens
STLAEFVNI

SEQ ID NO: 1394932 - protein, 9 aa, Homo Sapiens
LCKNELETE

SEQ ID NO: 1394933 - protein, 9 aa, Homo Sapiens
RIGATTPPI

SEQ ID NO: 1394934 - protein, 9 aa, Homo Sapiens
ATDSEDEKG

SEQ ID NO: 1394935 - protein, 9 aa, Homo Sapiens
HYNVLMSPR

SEQ ID NO: 1394936 - protein, 9 aa, Homo Sapiens
GSGGCHSHH

SEQ ID NO: 1394937 - protein, 9 aa, Homo Sapiens
QEAFNCFFT

SEQ ID NO: 1394938 - protein, 9 aa, Homo Sapiens
YFTQESSIL

SEQ ID NO: 1394939 - protein, 9 aa, Homo Sapiens
TPRPHGLQS

SEQ ID NO: 1394940 - protein, 9 aa, Homo Sapiens
VQKNLPLCS

SEQ ID NO: 1394941 - protein, 9 aa, Homo Sapiens
LGSGGCHSH

SEQ ID NO: 1394942 - protein, 9 aa, Homo Sapiens
EAFPLPRAS

SEQ ID NO: 1394943 - protein, 9 aa, Homo Sapiens
PSAGRTSAR

SEQ ID NO: 1394944 - protein, 9 aa, Homo Sapiens
RQSASCGCT

SEQ ID NO: 1394945 - protein, 9 aa, Homo Sapiens
SRLSTSAPT

SEQ ID NO: 1394946 - protein, 9 aa, Homo Sapiens
ASRKTWQRR

SEQ ID NO: 1394947 - protein, 9 aa, Homo Sapiens
LVAHYVLGC

SEQ ID NO: 1394948 - protein, 9 aa, Homo Sapiens
PGGRPWCRE

SEQ ID NO: 1394949 - protein, 9 aa, Homo Sapiens
RLWMATMRT

SEQ ID NO: 1394950 - protein, 9 aa, Homo Sapiens
LKNCIYPLS

SEQ ID NO: 1394951 - protein, 9 aa, Homo Sapiens
QQQVDIPIR

SEQ ID NO: 1394952 - protein, 9 aa, Homo Sapiens
PPTPASGGL

SEQ ID NO: 1394953 - protein, 9 aa, Homo Sapiens
CDSETTVMS

SEQ ID NO: 1394954 - protein, 9 aa, Homo Sapiens
RRWTAPLRP

SEQ ID NO: 1394955 - protein, 9 aa, Homo Sapiens
LVAPLASAP

SEQ ID NO: 1394956 - protein, 9 aa, Homo Sapiens
LDLSPLYRS

SEQ ID NO: 1394957 - protein, 9 aa, Homo Sapiens
DPIEAPPPS

SEQ ID NO: 1394958 - protein, 9 aa, Homo Sapiens
RLDSSAPRH

SEQ ID NO: 1394959 - protein, 9 aa, Homo Sapiens
GPTPPRSSP

SEQ ID NO: 1394960 - protein, 9 aa, Homo Sapiens
ERVLAYIQS

SEQ ID NO: 1394961 - protein, 9 aa, Homo Sapiens
DEEEKVLQL

SEQ ID NO: 1394962 - protein, 9 aa, Homo Sapiens
VALVFIKYL

SEQ ID NO: 1394963 - protein, 9 aa, Homo Sapiens
PPGAPLPKC

SEQ ID NO: 1394964 - protein, 9 aa, Homo Sapiens
PSILLTLLL

SEQ ID NO: 1394965 - protein, 9 aa, Homo Sapiens
VPRFSSPSS

SEQ ID NO: 1394966 - protein, 9 aa, Homo Sapiens
ARIIYPQRP

SEQ ID NO: 1394967 - protein, 9 aa, Homo Sapiens
NGWWGQKTK

SEQ ID NO: 1394968 - protein, 9 aa, Homo Sapiens
FWSVWPVES

SEQ ID NO: 1394969 - protein, 9 aa, Homo Sapiens
DVNKRLEKP

SEQ ID NO: 1394970 - protein, 9 aa, Homo Sapiens
LLGSGGCHS

SEQ ID NO: 1394971 - protein, 9 aa, Homo Sapiens
QQQTEKPVW

SEQ ID NO: 1394972 - protein, 9 aa, Homo Sapiens
GPRSCSEAA

SEQ ID NO: 1394973 - protein, 9 aa, Homo Sapiens
RSPTSSPTA

SEQ ID NO: 1394974 - protein, 9 aa, Homo Sapiens
PSSEPKEEE

SEQ ID NO: 1394975 - protein, 9 aa, Homo Sapiens
LLEQQILST

SEQ ID NO: 1394976 - protein, 9 aa, Homo Sapiens
RLLLPRLHV

SEQ ID NO: 1394977 - protein, 9 aa, Homo Sapiens
YSSVCVLPT

SEQ ID NO: 1394978 - protein, 9 aa, Homo Sapiens
TNVRDSVTK

SEQ ID NO: 1394979 - protein, 9 aa, Homo Sapiens
IQRELLKTL

SEQ ID NO: 1394980 - protein, 9 aa, Homo Sapiens
APSCTARAP

SEQ ID NO: 1394981 - protein, 9 aa, Homo Sapiens
SVLSQVQLS

SEQ ID NO: 1394982 - protein, 9 aa, Homo Sapiens
CVLPTRIAW

SEQ ID NO: 1394983 - protein, 9 aa, Homo Sapiens
ITLNQRVQM

SEQ ID NO: 1394984 - protein, 9 aa, Homo Sapiens
HHPRSRPGP

SEQ ID NO: 1394985 - protein, 9 aa, Homo Sapiens
LPLVVLCLT

SEQ ID NO: 1394986 - protein, 9 aa, Homo Sapiens
LAGAMNSMT

SEQ ID NO: 1394987 - protein, 9 aa, Homo Sapiens
NMGGNRSIC

SEQ ID NO: 1394988 - protein, 9 aa, Homo Sapiens
VDAREREHI

SEQ ID NO: 1394989 - protein, 9 aa, Homo Sapiens
MLPSSCPLL

SEQ ID NO: 1394990 - protein, 9 aa, Homo Sapiens
KFTSLATAW

SEQ ID NO: 1394991 - protein, 9 aa, Homo Sapiens
SGLFLLVAL

SEQ ID NO: 1394992 - protein, 9 aa, Homo Sapiens
TGPPPAVGA

SEQ ID NO: 1394993 - protein, 9 aa, Homo Sapiens
LFVQQPEFH

SEQ ID NO: 1394994 - protein, 9 aa, Homo Sapiens
AGVDWKMTN

SEQ ID NO: 1394995 - protein, 9 aa, Homo Sapiens
DIDPPKICC

SEQ ID NO: 1394996 - protein, 9 aa, Homo Sapiens
PRRLRRAAN

SEQ ID NO: 1394997 - protein, 9 aa, Homo Sapiens
ACWISSSLS

SEQ ID NO: 1394998 - protein, 9 aa, Homo Sapiens
KANFFQMVI

SEQ ID NO: 1394999 - protein, 9 aa, Homo Sapiens
RLRLRLPRT

SEQ ID NO: 1395000 - protein, 9 aa, Homo Sapiens
HQNLVYLAT

SEQ ID NO: 1395001 - protein, 9 aa, Homo Sapiens
SENHKVYIW

SEQ ID NO: 1395002 - protein, 9 aa, Homo Sapiens
LVALSLDRC

SEQ ID NO: 1395003 - protein, 9 aa, Homo Sapiens
PGTCAARSQ

SEQ ID NO: 1395004 - protein, 9 aa, Homo Sapiens
LILKIIRRR

SEQ ID NO: 1395005 - protein, 9 aa, Homo Sapiens
RPPAASGCP

SEQ ID NO: 1395006 - protein, 9 aa, Homo Sapiens
AHSSHQAYG

SEQ ID NO: 1395007 - protein, 9 aa, Homo Sapiens
AIDGHRGQC

SEQ ID NO: 1395008 - protein, 9 aa, Homo Sapiens
PRAWGRLCV

SEQ ID NO: 1395009 - protein, 9 aa, Homo Sapiens
GSARRSRRA

SEQ ID NO: 1395010 - protein, 9 aa, Homo Sapiens
TQYQQILHQ

SEQ ID NO: 1395011 - protein, 9 aa, Homo Sapiens
YWTSWRTKE

SEQ ID NO: 1395012 - protein, 9 aa, Homo Sapiens
WNPSQISGL

SEQ ID NO: 1395013 - protein, 9 aa, Homo Sapiens
LVNKTRWQY

SEQ ID NO: 1395014 - protein, 9 aa, Homo Sapiens
YASTTGASE

SEQ ID NO: 1395015 - protein, 9 aa, Homo Sapiens
PGDSDVSLH

SEQ ID NO: 1395016 - protein, 9 aa, Homo Sapiens
LKVATDLQL

SEQ ID NO: 1395017 - protein, 9 aa, Homo Sapiens
NNLTHLPNG

SEQ ID NO: 1395018 - protein, 9 aa, Homo Sapiens
FCLRGHPSA

SEQ ID NO: 1395019 - protein, 9 aa, Homo Sapiens
KSSPLPSST

SEQ ID NO: 1395020 - protein, 9 aa, Homo Sapiens
LERQEARLQ

SEQ ID NO: 1395021 - protein, 9 aa, Homo Sapiens
QKMYEHLWT

SEQ ID NO: 1395022 - protein, 9 aa, Homo Sapiens
CGHLKPSGE

SEQ ID NO: 1395023 - protein, 9 aa, Homo Sapiens
GCTNVRDSV

SEQ ID NO: 1395024 - protein, 9 aa, Homo Sapiens
VLPVGAMVN

SEQ ID NO: 1395025 - protein, 9 aa, Homo Sapiens
DPLVQSLHQ

SEQ ID NO: 1395026 - protein, 9 aa, Homo Sapiens
PQGPSCSRG

SEQ ID NO: 1395027 - protein, 9 aa, Homo Sapiens
AAAASPRAA

SEQ ID NO: 1395028 - protein, 9 aa, Homo Sapiens
WSRSRGLPR

SEQ ID NO: 1395029 - protein, 9 aa, Homo Sapiens
SSYSCGSGL

SEQ ID NO: 1395030 - protein, 9 aa, Homo Sapiens
PAEEEEEGH

SEQ ID NO: 1395031 - protein, 9 aa, Homo Sapiens
VPPVLERRG

SEQ ID NO: 1395032 - protein, 9 aa, Homo Sapiens
TPPIGPSCV

SEQ ID NO: 1395033 - protein, 9 aa, Homo Sapiens
FNGESSWLP

SEQ ID NO: 1395034 - protein, 9 aa, Homo Sapiens
LKKCSLYGK

SEQ ID NO: 1395035 - protein, 9 aa, Homo Sapiens
STRKNGGGL

SEQ ID NO: 1395036 - protein, 9 aa, Homo Sapiens
VWKRETIVL

SEQ ID NO: 1395037 - protein, 9 aa, Homo Sapiens
LLLLEVKLK

SEQ ID NO: 1395038 - protein, 9 aa, Homo Sapiens
WGNGWWGQK

SEQ ID NO: 1395039 - protein, 9 aa, Homo Sapiens
LFCGNIFLP

SEQ ID NO: 1395040 - protein, 9 aa, Homo Sapiens
PSACDACVG

SEQ ID NO: 1395041 - protein, 9 aa, Homo Sapiens
GRSRAGLIL

SEQ ID NO: 1395042 - protein, 9 aa, Homo Sapiens
GYTFVAFGP

SEQ ID NO: 1395043 - protein, 9 aa, Homo Sapiens
FLPVKGITE

SEQ ID NO: 1395044 - protein, 9 aa, Homo Sapiens
PETSDPSEE

SEQ ID NO: 1395045 - protein, 9 aa, Homo Sapiens
VHLQTLLEN

SEQ ID NO: 1395046 - protein, 9 aa, Homo Sapiens
FGKHIILFL

SEQ ID NO: 1395047 - protein, 9 aa, Homo Sapiens
KPWKNSESM

SEQ ID NO: 1395048 - protein, 9 aa, Homo Sapiens
QLSDPGVCI

SEQ ID NO: 1395049 - protein, 9 aa, Homo Sapiens
QIPGLLGSP

SEQ ID NO: 1395050 - protein, 9 aa, Homo Sapiens
DIAKNADKV

SEQ ID NO: 1395051 - protein, 9 aa, Homo Sapiens
QKEQSLWKL

SEQ ID NO: 1395052 - protein, 9 aa, Homo Sapiens
FKLAQESGH

SEQ ID NO: 1395053 - protein, 9 aa, Homo Sapiens
GIWEVMPRT

SEQ ID NO: 1395054 - protein, 9 aa, Homo Sapiens
VRVTVLLLL

SEQ ID NO: 1395055 - protein, 9 aa, Homo Sapiens
PAIPAHPAL

SEQ ID NO: 1395056 - protein, 9 aa, Homo Sapiens
IKVSVELLR

SEQ ID NO: 1395057 - protein, 9 aa, Homo Sapiens
LCTSWVPRD

SEQ ID NO: 1395058 - protein, 9 aa, Homo Sapiens
PFDGKDGLM

SEQ ID NO: 1395059 - protein, 9 aa, Homo Sapiens
IYPLSMCIN

SEQ ID NO: 1395060 - protein, 9 aa, Homo Sapiens
HPMKTAGKP

SEQ ID NO: 1395061 - protein, 9 aa, Homo Sapiens
QDTKLPKAE

SEQ ID NO: 1395062 - protein, 9 aa, Homo Sapiens
WPTRRSTMS

SEQ ID NO: 1395063 - protein, 9 aa, Homo Sapiens
ACNPSDRQD

SEQ ID NO: 1395064 - protein, 9 aa, Homo Sapiens
ASLFQPPHR

SEQ ID NO: 1395065 - protein, 9 aa, Homo Sapiens
VPSAECSVL

SEQ ID NO: 1395066 - protein, 9 aa, Homo Sapiens
TQPSFAPES

SEQ ID NO: 1395067 - protein, 9 aa, Homo Sapiens
GVDWKMTNV

SEQ ID NO: 1395068 - protein, 9 aa, Homo Sapiens
LLDDANLCK

SEQ ID NO: 1395069 - protein, 9 aa, Homo Sapiens
CPGTLSFPL

SEQ ID NO: 1395070 - protein, 9 aa, Homo Sapiens
KCSLIDKKA

SEQ ID NO: 1395071 - protein, 9 aa, Homo Sapiens
DTEAEKGKE

SEQ ID NO: 1395072 - protein, 9 aa, Homo Sapiens
CHPLHYNVL

SEQ ID NO: 1395073 - protein, 9 aa, Homo Sapiens
GPWGRSRAG

SEQ ID NO: 1395074 - protein, 9 aa, Homo Sapiens
ALVALVFIK

SEQ ID NO: 1395075 - protein, 9 aa, Homo Sapiens
VRSGGSPIS

SEQ ID NO: 1395076 - protein, 9 aa, Homo Sapiens
ARIVCVTSA

SEQ ID NO: 1395077 - protein, 9 aa, Homo Sapiens
EEGYYYRET

SEQ ID NO: 1395078 - protein, 9 aa, Homo Sapiens
LYYTEFLFL

SEQ ID NO: 1395079 - protein, 9 aa, Homo Sapiens
YRSHGASCT

SEQ ID NO: 1395080 - protein, 9 aa, Homo Sapiens
DEHLQALFQ

SEQ ID NO: 1395081 - protein, 9 aa, Homo Sapiens
AELLLSQYP

SEQ ID NO: 1395082 - protein, 9 aa, Homo Sapiens
GLEGDLQHA

SEQ ID NO: 1395083 - protein, 9 aa, Homo Sapiens
LAFSVTTWA

SEQ ID NO: 1395084 - protein, 9 aa, Homo Sapiens
VIITYDVLH

SEQ ID NO: 1395085 - protein, 9 aa, Homo Sapiens
ILVRIGSGK

SEQ ID NO: 1395086 - protein, 9 aa, Homo Sapiens
VFSFGTRAS

SEQ ID NO: 1395087 - protein, 9 aa, Homo Sapiens
VEFHYFQQM

SEQ ID NO: 1395088 - protein, 9 aa, Homo Sapiens
EVIASLPDL

SEQ ID NO: 1395089 - protein, 9 aa, Homo Sapiens
MGLPPLPGA

SEQ ID NO: 1395090 - protein, 9 aa, Homo Sapiens
TTRVPDEAD

SEQ ID NO: 1395091 - protein, 9 aa, Homo Sapiens
RTMAGPSAS

SEQ ID NO: 1395092 - protein, 9 aa, Homo Sapiens
PTKKKGAKA

SEQ ID NO: 1395093 - protein, 9 aa, Homo Sapiens
ARSARRWTA

SEQ ID NO: 1395094 - protein, 9 aa, Homo Sapiens
RKPHSPPRA

SEQ ID NO: 1395095 - protein, 9 aa, Homo Sapiens
RAIPKKAFC

SEQ ID NO: 1395096 - protein, 9 aa, Homo Sapiens
VCENCKPLR

SEQ ID NO: 1395097 - protein, 9 aa, Homo Sapiens
TWLEPCTPV

SEQ ID NO: 1395098 - protein, 9 aa, Homo Sapiens
YTYKGKSLE

SEQ ID NO: 1395099 - protein, 9 aa, Homo Sapiens
PTVPDLPPP

SEQ ID NO: 1395100 - protein, 9 aa, Homo Sapiens
SPVGRLCCH

SEQ ID NO: 1395101 - protein, 9 aa, Homo Sapiens
AECSVLPRR

SEQ ID NO: 1395102 - protein, 9 aa, Homo Sapiens
QILHPYNTF

SEQ ID NO: 1395103 - protein, 9 aa, Homo Sapiens
LQKGKKRGK

SEQ ID NO: 1395104 - protein, 9 aa, Homo Sapiens
CLRGHPSAF

SEQ ID NO: 1395105 - protein, 9 aa, Homo Sapiens
LLRYPSLLE

SEQ ID NO: 1395106 - protein, 9 aa, Homo Sapiens
LSQLHHSMT

SEQ ID NO: 1395107 - protein, 9 aa, Homo Sapiens
GLDSFELIS

SEQ ID NO: 1395108 - protein, 9 aa, Homo Sapiens
VQGSIRQFV

SEQ ID NO: 1395109 - protein, 9 aa, Homo Sapiens
WISSSLSLL

SEQ ID NO: 1395110 - protein, 9 aa, Homo Sapiens
NDTVSDNDA

SEQ ID NO: 1395111 - protein, 9 aa, Homo Sapiens
CSCNPEWLV

SEQ ID NO: 1395112 - protein, 9 aa, Homo Sapiens
LSFPLLITS

SEQ ID NO: 1395113 - protein, 9 aa, Homo Sapiens
CCPPGHPCS

SEQ ID NO: 1395114 - protein, 9 aa, Homo Sapiens
PGTLSFPLL

SEQ ID NO: 1395115 - protein, 9 aa, Homo Sapiens
RFSSPSSCN

SEQ ID NO: 1395116 - protein, 9 aa, Homo Sapiens
GAQANLEHS

SEQ ID NO: 1395117 - protein, 9 aa, Homo Sapiens
QSQSRPRKS

SEQ ID NO: 1395118 - protein, 9 aa, Homo Sapiens
QLIIIPFRH

SEQ ID NO: 1395119 - protein, 9 aa, Homo Sapiens
THLPNGLLG

SEQ ID NO: 1395120 - protein, 9 aa, Homo Sapiens
PDLAPGLIT

SEQ ID NO: 1395121 - protein, 9 aa, Homo Sapiens
EIYGKCFPF

SEQ ID NO: 1395122 - protein, 9 aa, Homo Sapiens
WSRCSLRQM

SEQ ID NO: 1395123 - protein, 9 aa, Homo Sapiens
LQQRHSVLR

SEQ ID NO: 1395124 - protein, 9 aa, Homo Sapiens
SNGDVNART

SEQ ID NO: 1395125 - protein, 9 aa, Homo Sapiens
NKPTPNDKG

SEQ ID NO: 1395126 - protein, 9 aa, Homo Sapiens
HVKQEEKLS

SEQ ID NO: 1395127 - protein, 9 aa, Homo Sapiens
LWTSLKQME

SEQ ID NO: 1395128 - protein, 9 aa, Homo Sapiens
TAGKPWLLR

SEQ ID NO: 1395129 - protein, 9 aa, Homo Sapiens
WGARRGVKK

SEQ ID NO: 1395130 - protein, 9 aa, Homo Sapiens
CGREYVQAG

SEQ ID NO: 1395131 - protein, 9 aa, Homo Sapiens
LLTWLEPCT

SEQ ID NO: 1395132 - protein, 9 aa, Homo Sapiens
DTPEEILVR

SEQ ID NO: 1395133 - protein, 9 aa, Homo Sapiens
PSARSPTWC

SEQ ID NO: 1395134 - protein, 9 aa, Homo Sapiens
EKVLQLTVR

SEQ ID NO: 1395135 - protein, 9 aa, Homo Sapiens
DAKDAVDLR

SEQ ID NO: 1395136 - protein, 9 aa, Homo Sapiens
CCRDVVLMQ

SEQ ID NO: 1395137 - protein, 9 aa, Homo Sapiens
YLQTTDYGN

SEQ ID NO: 1395138 - protein, 9 aa, Homo Sapiens
LGIRGSWMG

SEQ ID NO: 1395139 - protein, 9 aa, Homo Sapiens
NKKKCRSYW

SEQ ID NO: 1395140 - protein, 9 aa, Homo Sapiens
TTVMSLGED

SEQ ID NO: 1395141 - protein, 9 aa, Homo Sapiens
REVRRLPKP

SEQ ID NO: 1395142 - protein, 9 aa, Homo Sapiens
IVCVTSAPN

SEQ ID NO: 1395143 - protein, 9 aa, Homo Sapiens
RIKSAAMLA

SEQ ID NO: 1395144 - protein, 9 aa, Homo Sapiens
GHPEPLDGA

SEQ ID NO: 1395145 - protein, 9 aa, Homo Sapiens
MVHFTVREA

SEQ ID NO: 1395146 - protein, 9 aa, Homo Sapiens
SCTDSSVNF

SEQ ID NO: 1395147 - protein, 9 aa, Homo Sapiens
PPGDTSEVS

SEQ ID NO: 1395148 - protein, 9 aa, Homo Sapiens
CPRKAHPCP

SEQ ID NO: 1395149 - protein, 9 aa, Homo Sapiens
DSSVNFLMV

SEQ ID NO: 1395150 - protein, 9 aa, Homo Sapiens
TKLPKAEEC

SEQ ID NO: 1395151 - protein, 9 aa, Homo Sapiens
PGPRMGPVS

SEQ ID NO: 1395152 - protein, 9 aa, Homo Sapiens
LVLHRLLQE

SEQ ID NO: 1395153 - protein, 9 aa, Homo Sapiens
LSGRVAVVP

SEQ ID NO: 1395154 - protein, 9 aa, Homo Sapiens
LSASSPQTP

SEQ ID NO: 1395155 - protein, 9 aa, Homo Sapiens
WSVWPVESH

SEQ ID NO: 1395156 - protein, 9 aa, Homo Sapiens
HLFGTSYPH

SEQ ID NO: 1395157 - protein, 9 aa, Homo Sapiens
PIHQHEDCC

SEQ ID NO: 1395158 - protein, 9 aa, Homo Sapiens
PKTGVCHLC

SEQ ID NO: 1395159 - protein, 9 aa, Homo Sapiens
GKKMDLDGM

SEQ ID NO: 1395160 - protein, 9 aa, Homo Sapiens
LQPPGDCPR

SEQ ID NO: 1395161 - protein, 9 aa, Homo Sapiens
LRVGLRHKL

SEQ ID NO: 1395162 - protein, 9 aa, Homo Sapiens
FSPVIEYSV

SEQ ID NO: 1395163 - protein, 9 aa, Homo Sapiens
EGYYYRETY

SEQ ID NO: 1395164 - protein, 9 aa, Homo Sapiens
SSLPCFLEL

SEQ ID NO: 1395165 - protein, 9 aa, Homo Sapiens
FLDIVPHLL

SEQ ID NO: 1395166 - protein, 9 aa, Homo Sapiens
LRQLLHGRW

SEQ ID NO: 1395167 - protein, 9 aa, Homo Sapiens
FFVLVNLEV

SEQ ID NO: 1395168 - protein, 9 aa, Homo Sapiens
QIYSEFRKI

SEQ ID NO: 1395169 - protein, 9 aa, Homo Sapiens
WLQINKPTP

SEQ ID NO: 1395170 - protein, 9 aa, Homo Sapiens
KICDFGTTC

SEQ ID NO: 1395171 - protein, 9 aa, Homo Sapiens
SLGSRLHSW

SEQ ID NO: 1395172 - protein, 9 aa, Homo Sapiens
ECKTCGTMF

SEQ ID NO: 1395173 - protein, 9 aa, Homo Sapiens
GASDILEET

SEQ ID NO: 1395174 - protein, 9 aa, Homo Sapiens
GDVDGPGGP

SEQ ID NO: 1395175 - protein, 9 aa, Homo Sapiens
DRGFVLMGS

SEQ ID NO: 1395176 - protein, 9 aa, Homo Sapiens
LISLADYPA

SEQ ID NO: 1395177 - protein, 9 aa, Homo Sapiens
TGKVCYDLT

SEQ ID NO: 1395178 - protein, 9 aa, Homo Sapiens
SQNHSKCIT

SEQ ID NO: 1395179 - protein, 9 aa, Homo Sapiens
KKPSKRRWS

SEQ ID NO: 1395180 - protein, 9 aa, Homo Sapiens
RKFSCHIRA

SEQ ID NO: 1395181 - protein, 9 aa, Homo Sapiens
PSQRSAEQS

SEQ ID NO: 1395182 - protein, 9 aa, Homo Sapiens
YRSPHPSRQ

SEQ ID NO: 1395183 - protein, 9 aa, Homo Sapiens
PPPHLRQLL

SEQ ID NO: 1395184 - protein, 9 aa, Homo Sapiens
LWTIPVTVL

SEQ ID NO: 1395185 - protein, 9 aa, Homo Sapiens
EGHQELDEV

SEQ ID NO: 1395186 - protein, 9 aa, Homo Sapiens
MEDATEREE

SEQ ID NO: 1395187 - protein, 9 aa, Homo Sapiens
LSVALDILP

SEQ ID NO: 1395188 - protein, 9 aa, Homo Sapiens
SPLYRSPHP

SEQ ID NO: 1395189 - protein, 9 aa, Homo Sapiens
ASDILEETW

SEQ ID NO: 1395190 - protein, 9 aa, Homo Sapiens
HSPDPSMTT

SEQ ID NO: 1395191 - protein, 9 aa, Homo Sapiens
KCRSYWTSW

SEQ ID NO: 1395192 - protein, 9 aa, Homo Sapiens
LLEEQWGAL

SEQ ID NO: 1395193 - protein, 9 aa, Homo Sapiens
RPLSGPPPS

SEQ ID NO: 1395194 - protein, 9 aa, Homo Sapiens
TVIKKRDQC

SEQ ID NO: 1395195 - protein, 9 aa, Homo Sapiens
IHNSVKNSS

SEQ ID NO: 1395196 - protein, 9 aa, Homo Sapiens
SESDSQASR

SEQ ID NO: 1395197 - protein, 9 aa, Homo Sapiens
GGSLASGAP

SEQ ID NO: 1395198 - protein, 9 aa, Homo Sapiens
AAERQREHY

SEQ ID NO: 1395199 - protein, 9 aa, Homo Sapiens
AVIADGKYF

SEQ ID NO: 1395200 - protein, 9 aa, Homo Sapiens
STARGCRNY

SEQ ID NO: 1395201 - protein, 9 aa, Homo Sapiens
NIANTESSR

SEQ ID NO: 1395202 - protein, 9 aa, Homo Sapiens
HSSHQAYGA

SEQ ID NO: 1395203 - protein, 9 aa, Homo Sapiens
TSRCCPPGH

SEQ ID NO: 1395204 - protein, 9 aa, Homo Sapiens
YSRDTKLPA

SEQ ID NO: 1395205 - protein, 9 aa, Homo Sapiens
SQGTVFPLC

SEQ ID NO: 1395206 - protein, 9 aa, Homo Sapiens
HCKYYSTTH

SEQ ID NO: 1395207 - protein, 9 aa, Homo Sapiens
NSSESHISS

SEQ ID NO: 1395208 - protein, 9 aa, Homo Sapiens
PQWATINTS

SEQ ID NO: 1395209 - protein, 9 aa, Homo Sapiens
RGFLLHQPL

SEQ ID NO: 1395210 - protein, 9 aa, Homo Sapiens
NEGASSPGI

SEQ ID NO: 1395211 - protein, 9 aa, Homo Sapiens
GTYQPEPGH

SEQ ID NO: 1395212 - protein, 9 aa, Homo Sapiens
EEQMSVIWD

SEQ ID NO: 1395213 - protein, 9 aa, Homo Sapiens
KQSQSRPRK

SEQ ID NO: 1395214 - protein, 9 aa, Homo Sapiens
VPACWISSS

SEQ ID NO: 1395215 - protein, 9 aa, Homo Sapiens
RSGGSPISP

SEQ ID NO: 1395216 - protein, 9 aa, Homo Sapiens
SSAPTGAEA

SEQ ID NO: 1395217 - protein, 9 aa, Homo Sapiens
KDPKKRSKK

SEQ ID NO: 1395218 - protein, 9 aa, Homo Sapiens
GWSTRGRSV

SEQ ID NO: 1395219 - protein, 9 aa, Homo Sapiens
EKGYELVPI

SEQ ID NO: 1395220 - protein, 9 aa, Homo Sapiens
DDEDGLEQD

SEQ ID NO: 1395221 - protein, 9 aa, Homo Sapiens
AHQITLLEC

SEQ ID NO: 1395222 - protein, 9 aa, Homo Sapiens
KLFQLGPLH

SEQ ID NO: 1395223 - protein, 9 aa, Homo Sapiens
QGPSCSRGS

SEQ ID NO: 1395224 - protein, 9 aa, Homo Sapiens
RAAQCPLLD

SEQ ID NO: 1395225 - protein, 9 aa, Homo Sapiens
CGFATRGWR

SEQ ID NO: 1395226 - protein, 9 aa, Homo Sapiens
PVSPATTRR

SEQ ID NO: 1395227 - protein, 9 aa, Homo Sapiens
ISRICEAVP

SEQ ID NO: 1395228 - protein, 9 aa, Homo Sapiens
EASTIVLLN

SEQ ID NO: 1395229 - protein, 9 aa, Homo Sapiens
LWGPQTILL

SEQ ID NO: 1395230 - protein, 9 aa, Homo Sapiens
ERRATRIAC

SEQ ID NO: 1395231 - protein, 9 aa, Homo Sapiens
SGRGSNSWV

SEQ ID NO: 1395232 - protein, 9 aa, Homo Sapiens
IKKRDQCFQ

SEQ ID NO: 1395233 - protein, 9 aa, Homo Sapiens
TDSSVNFLM

SEQ ID NO: 1395234 - protein, 9 aa, Homo Sapiens
KCYGHGVGR

SEQ ID NO: 1395235 - protein, 9 aa, Homo Sapiens
EVMPRTLEG

SEQ ID NO: 1395236 - protein, 9 aa, Homo Sapiens
NVAFELDHT

SEQ ID NO: 1395237 - protein, 9 aa, Homo Sapiens
AEDGDPGDI

SEQ ID NO: 1395238 - protein, 9 aa, Homo Sapiens
RTLTEYARP

SEQ ID NO: 1395239 - protein, 9 aa, Homo Sapiens
ENLMSQEYS

SEQ ID NO: 1395240 - protein, 9 aa, Homo Sapiens
FIPTTEGVS

SEQ ID NO: 1395241 - protein, 9 aa, Homo Sapiens
IHCQEVRIS

SEQ ID NO: 1395242 - protein, 9 aa, Homo Sapiens
AFDRNFGTK

SEQ ID NO: 1395243 - protein, 9 aa, Homo Sapiens
SEDGVRAPF

SEQ ID NO: 1395244 - protein, 9 aa, Homo Sapiens
FLLLWRLFL

SEQ ID NO: 1395245 - protein, 9 aa, Homo Sapiens
NLSKVIPQK

SEQ ID NO: 1395246 - protein, 9 aa, Homo Sapiens
LEAFPLPRA

SEQ ID NO: 1395247 - protein, 9 aa, Homo Sapiens
KSLQKICSL

SEQ ID NO: 1395248 - protein, 9 aa, Homo Sapiens
LPPPTCPLG

SEQ ID NO: 1395249 - protein, 9 aa, Homo Sapiens
RRPSRDSLG

SEQ ID NO: 1395250 - protein, 9 aa, Homo Sapiens
GCISVKDHR

SEQ ID NO: 1395251 - protein, 9 aa, Homo Sapiens
ILHPYNTFA

SEQ ID NO: 1395252 - protein, 9 aa, Homo Sapiens
ESDSQASRE

SEQ ID NO: 1395253 - protein, 9 aa, Homo Sapiens
PAVTATSAN

SEQ ID NO: 1395254 - protein, 9 aa, Homo Sapiens
FSCTSLDAM

SEQ ID NO: 1395255 - protein, 9 aa, Homo Sapiens
EHFLISAFS

SEQ ID NO: 1395256 - protein, 9 aa, Homo Sapiens
TLLSTHRLI

SEQ ID NO: 1395257 - protein, 9 aa, Homo Sapiens
LTCSFKEHF

SEQ ID NO: 1395258 - protein, 9 aa, Homo Sapiens
FSFFFCLRG

SEQ ID NO: 1395259 - protein, 9 aa, Homo Sapiens
RRLRACRAG

SEQ ID NO: 1395260 - protein, 9 aa, Homo Sapiens
DTSGLWFTS

SEQ ID NO: 1395261 - protein, 9 aa, Homo Sapiens
ELTVVTRVW

SEQ ID NO: 1395262 - protein, 9 aa, Homo Sapiens
LSSTMLPVQ

SEQ ID NO: 1395263 - protein, 9 aa, Homo Sapiens
HQNLQEKLV

SEQ ID NO: 1395264 - protein, 9 aa, Homo Sapiens
HVGGKAPGV

SEQ ID NO: 1395265 - protein, 9 aa, Homo Sapiens
MPEQVHKVC

SEQ ID NO: 1395266 - protein, 9 aa, Homo Sapiens
DVLQAIQVE

SEQ ID NO: 1395267 - protein, 9 aa, Homo Sapiens
RLRRPGNWI

SEQ ID NO: 1395268 - protein, 9 aa, Homo Sapiens
GMTPPKSTE

SEQ ID NO: 1395269 - protein, 9 aa, Homo Sapiens
RHLVQLLRQ

SEQ ID NO: 1395270 - protein, 9 aa, Homo Sapiens
EMVMIMGVK

SEQ ID NO: 1395271 - protein, 9 aa, Homo Sapiens
MGARGPTPP

SEQ ID NO: 1395272 - protein, 9 aa, Homo Sapiens
KDSATDSED

SEQ ID NO: 1395273 - protein, 9 aa, Homo Sapiens
CSLLILICD

SEQ ID NO: 1395274 - protein, 9 aa, Homo Sapiens
AGSRTPIPT

SEQ ID NO: 1395275 - protein, 9 aa, Homo Sapiens
SVLQAAWPR

SEQ ID NO: 1395276 - protein, 9 aa, Homo Sapiens
TPTEPPLPT

SEQ ID NO: 1395277 - protein, 9 aa, Homo Sapiens
TAAKPSARS

SEQ ID NO: 1395278 - protein, 9 aa, Homo Sapiens
PNFFVTLLY

SEQ ID NO: 1395279 - protein, 9 aa, Homo Sapiens
LQHEYGPEE

SEQ ID NO: 1395280 - protein, 9 aa, Homo Sapiens
ESLTLEKKI

SEQ ID NO: 1395281 - protein, 9 aa, Homo Sapiens
CEIYGKCFP

SEQ ID NO: 1395282 - protein, 9 aa, Homo Sapiens
VNKTRWQYY

SEQ ID NO: 1395283 - protein, 9 aa, Homo Sapiens
RDPQQGQFI

SEQ ID NO: 1395284 - protein, 9 aa, Homo Sapiens
LKVPSAECS

SEQ ID NO: 1395285 - protein, 9 aa, Homo Sapiens
PTILYSGGR

SEQ ID NO: 1395286 - protein, 9 aa, Homo Sapiens
TARGCRNYP

SEQ ID NO: 1395287 - protein, 9 aa, Homo Sapiens
PRHPHRSPP

SEQ ID NO: 1395288 - protein, 9 aa, Homo Sapiens
PQQGQFIPS

SEQ ID NO: 1395289 - protein, 9 aa, Homo Sapiens
AIMASAQPT

SEQ ID NO: 1395290 - protein, 9 aa, Homo Sapiens
SGSRVRVGV

SEQ ID NO: 1395291 - protein, 9 aa, Homo Sapiens
ENKPPSRHV

SEQ ID NO: 1395292 - protein, 9 aa, Homo Sapiens
QNQNFQEML

SEQ ID NO: 1395293 - protein, 9 aa, Homo Sapiens
LLHIRGDDS

SEQ ID NO: 1395294 - protein, 9 aa, Homo Sapiens
RGLLLLEVK

SEQ ID NO: 1395295 - protein, 9 aa, Homo Sapiens
DYPDSQLPI

SEQ ID NO: 1395296 - protein, 9 aa, Homo Sapiens
TPNSTPPQR

SEQ ID NO: 1395297 - protein, 9 aa, Homo Sapiens
LYNICSIYN

SEQ ID NO: 1395298 - protein, 9 aa, Homo Sapiens
LGPSVTCGP

SEQ ID NO: 1395299 - protein, 9 aa, Homo Sapiens
QTLLENGTR

SEQ ID NO: 1395300 - protein, 9 aa, Homo Sapiens
SARRWTAPL

SEQ ID NO: 1395301 - protein, 9 aa, Homo Sapiens
RHFGWTPRP

SEQ ID NO: 1395302 - protein, 9 aa, Homo Sapiens
GFFRCSIRK

SEQ ID NO: 1395303 - protein, 9 aa, Homo Sapiens
LRSSWNRLR

SEQ ID NO: 1395304 - protein, 9 aa, Homo Sapiens
LMAHAFPPG

SEQ ID NO: 1395305 - protein, 9 aa, Homo Sapiens
RGGTTIGEV

SEQ ID NO: 1395306 - protein, 9 aa, Homo Sapiens
TAARPSATN

SEQ ID NO: 1395307 - protein, 9 aa, Homo Sapiens
PGDGDAHSS

SEQ ID NO: 1395308 - protein, 9 aa, Homo Sapiens
GQHFYWHCG

SEQ ID NO: 1395309 - protein, 9 aa, Homo Sapiens
SGVLTEKQE

SEQ ID NO: 1395310 - protein, 9 aa, Homo Sapiens
AVQAGDGHG

SEQ ID NO: 1395311 - protein, 9 aa, Homo Sapiens
NGIWEVMPR

SEQ ID NO: 1395312 - protein, 9 aa, Homo Sapiens
RPIQVQTGG

SEQ ID NO: 1395313 - protein, 9 aa, Homo Sapiens
ANSLSSAEG

SEQ ID NO: 1395314 - protein, 9 aa, Homo Sapiens
LRRPGNWIA

SEQ ID NO: 1395315 - protein, 9 aa, Homo Sapiens
HIILFLFLM

SEQ ID NO: 1395316 - protein, 9 aa, Homo Sapiens
GALMPAATI

SEQ ID NO: 1395317 - protein, 9 aa, Homo Sapiens
SWEETPVAE

SEQ ID NO: 1395318 - protein, 9 aa, Homo Sapiens
YFYAEQGDV

SEQ ID NO: 1395319 - protein, 9 aa, Homo Sapiens
DVGPVDAGR

SEQ ID NO: 1395320 - protein, 9 aa, Homo Sapiens
KAVLLGYPV

SEQ ID NO: 1395321 - protein, 9 aa, Homo Sapiens
NFCLLPQQR

SEQ ID NO: 1395322 - protein, 9 aa, Homo Sapiens
QMMEGKAFL

SEQ ID NO: 1395323 - protein, 9 aa, Homo Sapiens
PRPLSSKLG

SEQ ID NO: 1395324 - protein, 9 aa, Homo Sapiens
GAAGAASRS

SEQ ID NO: 1395325 - protein, 9 aa, Homo Sapiens
LMSHPRLCR

SEQ ID NO: 1395326 - protein, 9 aa, Homo Sapiens
VIGQGLVGM

SEQ ID NO: 1395327 - protein, 9 aa, Homo Sapiens
GLVGMTPRD

SEQ ID NO: 1395328 - protein, 9 aa, Homo Sapiens
NKAFSIKRG

SEQ ID NO: 1395329 - protein, 9 aa, Homo Sapiens
KFQLIIIPF

SEQ ID NO: 1395330 - protein, 9 aa, Homo Sapiens
DKKKGQHFY

SEQ ID NO: 1395331 - protein, 9 aa, Homo Sapiens
RLRDPSLQQ

SEQ ID NO: 1395332 - protein, 9 aa, Homo Sapiens
KKKTSRSQP

SEQ ID NO: 1395333 - protein, 9 aa, Homo Sapiens
IHTGVKPNE

SEQ ID NO: 1395334 - protein, 9 aa, Homo Sapiens
PPSRHVGGK

SEQ ID NO: 1395335 - protein, 9 aa, Homo Sapiens
LYVNTVTLA

SEQ ID NO: 1395336 - protein, 9 aa, Homo Sapiens
VAFELDHTR

SEQ ID NO: 1395337 - protein, 9 aa, Homo Sapiens
VVAERLEAM

SEQ ID NO: 1395338 - protein, 9 aa, Homo Sapiens
QLLLCLMVI

SEQ ID NO: 1395339 - protein, 9 aa, Homo Sapiens
GAMVNMDGT

SEQ ID NO: 1395340 - protein, 9 aa, Homo Sapiens
NVPRLDHFL

SEQ ID NO: 1395341 - protein, 9 aa, Homo Sapiens
PASPLKRDP

SEQ ID NO: 1395342 - protein, 9 aa, Homo Sapiens
SACDACVGM

SEQ ID NO: 1395343 - protein, 9 aa, Homo Sapiens
DPQQGQFIP

SEQ ID NO: 1395344 - protein, 9 aa, Homo Sapiens
EGASSPGIL

SEQ ID NO: 1395345 - protein, 9 aa, Homo Sapiens
AVFFGYTFV

SEQ ID NO: 1395346 - protein, 9 aa, Homo Sapiens
HSQPVQEAE

SEQ ID NO: 1395347 - protein, 9 aa, Homo Sapiens
TLECIASVR

SEQ ID NO: 1395348 - protein, 9 aa, Homo Sapiens
EPGHTGCFP

SEQ ID NO: 1395349 - protein, 9 aa, Homo Sapiens
DPGCQMCAA

SEQ ID NO: 1395350 - protein, 9 aa, Homo Sapiens
FKTVIKKRD

SEQ ID NO: 1395351 - protein, 9 aa, Homo Sapiens
RGWRAQALL

SEQ ID NO: 1395352 - protein, 9 aa, Homo Sapiens
FEVSGIRPG

SEQ ID NO: 1395353 - protein, 9 aa, Homo Sapiens
IANTESSRQ

SEQ ID NO: 1395354 - protein, 9 aa, Homo Sapiens
GFLLHQPLP

SEQ ID NO: 1395355 - protein, 9 aa, Homo Sapiens
KGLPVGFIH

SEQ ID NO: 1395356 - protein, 9 aa, Homo Sapiens
NLKNCIYPL

SEQ ID NO: 1395357 - protein, 9 aa, Homo Sapiens
PVPPVLERR

SEQ ID NO: 1395358 - protein, 9 aa, Homo Sapiens
ALRDNHLEI

SEQ ID NO: 1395359 - protein, 9 aa, Homo Sapiens
YILNLVAAG

SEQ ID NO: 1395360 - protein, 9 aa, Homo Sapiens
AILRVILEV

SEQ ID NO: 1395361 - protein, 9 aa, Homo Sapiens
ASSLLCSGQ

SEQ ID NO: 1395362 - protein, 9 aa, Homo Sapiens
LPRAWGRLC

SEQ ID NO: 1395363 - protein, 9 aa, Homo Sapiens
FGWTPRPHG

SEQ ID NO: 1395364 - protein, 9 aa, Homo Sapiens
SARGPVRLL

SEQ ID NO: 1395365 - protein, 9 aa, Homo Sapiens
QQQALRFQG

SEQ ID NO: 1395366 - protein, 9 aa, Homo Sapiens
LPTASGLKN

SEQ ID NO: 1395367 - protein, 9 aa, Homo Sapiens
GMGGQPREP

SEQ ID NO: 1395368 - protein, 9 aa, Homo Sapiens
INKPTPNDK

SEQ ID NO: 1395369 - protein, 9 aa, Homo Sapiens
FHFEELLVP

SEQ ID NO: 1395370 - protein, 9 aa, Homo Sapiens
LDMRPFLAK

SEQ ID NO: 1395371 - protein, 9 aa, Homo Sapiens
APSAGRTSA

SEQ ID NO: 1395372 - protein, 9 aa, Homo Sapiens
TCPLGSEGC

SEQ ID NO: 1395373 - protein, 9 aa, Homo Sapiens
DFAASQVVV

SEQ ID NO: 1395374 - protein, 9 aa, Homo Sapiens
LSFMGIFEL

SEQ ID NO: 1395375 - protein, 9 aa, Homo Sapiens
VGITLLPRA

SEQ ID NO: 1395376 - protein, 9 aa, Homo Sapiens
LVNMGGNRS

SEQ ID NO: 1395377 - protein, 9 aa, Homo Sapiens
EEVILALHS

SEQ ID NO: 1395378 - protein, 9 aa, Homo Sapiens
VALDILPLQ

SEQ ID NO: 1395379 - protein, 9 aa, Homo Sapiens
PLSGPPPSP

SEQ ID NO: 1395380 - protein, 9 aa, Homo Sapiens
ITYDVLHSE

SEQ ID NO: 1395381 - protein, 9 aa, Homo Sapiens
SAPTAAKPS

SEQ ID NO: 1395382 - protein, 9 aa, Homo Sapiens
YWHCGSAAC

SEQ ID NO: 1395383 - protein, 9 aa, Homo Sapiens
PLDSKDLEE

SEQ ID NO: 1395384 - protein, 9 aa, Homo Sapiens
AQANLEHSL

SEQ ID NO: 1395385 - protein, 9 aa, Homo Sapiens
TQLAVITSN

SEQ ID NO: 1395386 - protein, 9 aa, Homo Sapiens
ASIKVSVEL

SEQ ID NO: 1395387 - protein, 9 aa, Homo Sapiens
EHACTALQN

SEQ ID NO: 1395388 - protein, 9 aa, Homo Sapiens
AQAIAVQAG

SEQ ID NO: 1395389 - protein, 9 aa, Homo Sapiens
SGTAPSAVP

SEQ ID NO: 1395390 - protein, 9 aa, Homo Sapiens
LSQVQLSED

SEQ ID NO: 1395391 - protein, 9 aa, Homo Sapiens
KRIKSAAML

SEQ ID NO: 1395392 - protein, 9 aa, Homo Sapiens
CKREHSTLW

SEQ ID NO: 1395393 - protein, 9 aa, Homo Sapiens
LTVEILELA

SEQ ID NO: 1395394 - protein, 9 aa, Homo Sapiens
WCCSWHLPT

SEQ ID NO: 1395395 - protein, 9 aa, Homo Sapiens
IFRLYSRAV

SEQ ID NO: 1395396 - protein, 9 aa, Homo Sapiens
FFLQLQGLV

SEQ ID NO: 1395397 - protein, 9 aa, Homo Sapiens
APRHHPRSR

SEQ ID NO: 1395398 - protein, 9 aa, Homo Sapiens
GEATHCKYY

SEQ ID NO: 1395399 - protein, 9 aa, Homo Sapiens
AAGAASRSW

SEQ ID NO: 1395400 - protein, 9 aa, Homo Sapiens
SSPQTPYCI

SEQ ID NO: 1395401 - protein, 9 aa, Homo Sapiens
RPNMEGYRA

SEQ ID NO: 1395402 - protein, 9 aa, Homo Sapiens
FFFLHKEFL

SEQ ID NO: 1395403 - protein, 9 aa, Homo Sapiens
AAAILRVIL

SEQ ID NO: 1395404 - protein, 9 aa, Homo Sapiens
KDEEEKVLQ

SEQ ID NO: 1395405 - protein, 9 aa, Homo Sapiens
WCFPQPPKR

SEQ ID NO: 1395406 - protein, 9 aa, Homo Sapiens
CKMIYLAHN

SEQ ID NO: 1395407 - protein, 9 aa, Homo Sapiens
PLEGLDMRP

SEQ ID NO: 1395408 - protein, 9 aa, Homo Sapiens
PLELQPPGD

SEQ ID NO: 1395409 - protein, 9 aa, Homo Sapiens
LTGVPGGHA

SEQ ID NO: 1395410 - protein, 9 aa, Homo Sapiens
TPANRYRSL

SEQ ID NO: 1395411 - protein, 9 aa, Homo Sapiens
LLSPASRSL

SEQ ID NO: 1395412 - protein, 9 aa, Homo Sapiens
NSVLQAAWP

SEQ ID NO: 1395413 - protein, 9 aa, Homo Sapiens
RLIGCGGII

SEQ ID NO: 1395414 - protein, 9 aa, Homo Sapiens
SASLHPASG

SEQ ID NO: 1395415 - protein, 9 aa, Homo Sapiens
ASQVVVMQR

SEQ ID NO: 1395416 - protein, 9 aa, Homo Sapiens
LIELRKKIE

SEQ ID NO: 1395417 - protein, 9 aa, Homo Sapiens
PSLESSGYS

SEQ ID NO: 1395418 - protein, 9 aa, Homo Sapiens
RTQPSFAPE

SEQ ID NO: 1395419 - protein, 9 aa, Homo Sapiens
EVILALHSE

SEQ ID NO: 1395420 - protein, 9 aa, Homo Sapiens
AREREHIHA

SEQ ID NO: 1395421 - protein, 9 aa, Homo Sapiens
TLRKQPQGP

SEQ ID NO: 1395422 - protein, 9 aa, Homo Sapiens
VVNRGGRGL

SEQ ID NO: 1395423 - protein, 9 aa, Homo Sapiens
WWGNGWWGQ

SEQ ID NO: 1395424 - protein, 9 aa, Homo Sapiens
NQRVQMVHF

SEQ ID NO: 1395425 - protein, 9 aa, Homo Sapiens
RKKPSKRRW

SEQ ID NO: 1395426 - protein, 9 aa, Homo Sapiens
STPEGYDHP

SEQ ID NO: 1395427 - protein, 9 aa, Homo Sapiens
FELERTISS

SEQ ID NO: 1395428 - protein, 9 aa, Homo Sapiens
AALYEMPVP

SEQ ID NO: 1395429 - protein, 9 aa, Homo Sapiens
PEVDKYGMV

SEQ ID NO: 1395430 - protein, 9 aa, Homo Sapiens
RLCVRPREQ

SEQ ID NO: 1395431 - protein, 9 aa, Homo Sapiens
STGKTGWST

SEQ ID NO: 1395432 - protein, 9 aa, Homo Sapiens
DRGIDRVTI

SEQ ID NO: 1395433 - protein, 9 aa, Homo Sapiens
EDASVGWLQ

SEQ ID NO: 1395434 - protein, 9 aa, Homo Sapiens
VIPQKPNKR

SEQ ID NO: 1395435 - protein, 9 aa, Homo Sapiens
CSFKEHFSL

SEQ ID NO: 1395436 - protein, 9 aa, Homo Sapiens
ARRWTAPLR

SEQ ID NO: 1395437 - protein, 9 aa, Homo Sapiens
CAVNKGQPI

SEQ ID NO: 1395438 - protein, 9 aa, Homo Sapiens
EEEGHQELD

SEQ ID NO: 1395439 - protein, 9 aa, Homo Sapiens
PSQLPHTRI

SEQ ID NO: 1395440 - protein, 9 aa, Homo Sapiens
AFSIKRGPS

SEQ ID NO: 1395441 - protein, 9 aa, Homo Sapiens
QRTVAHQIT

SEQ ID NO: 1395442 - protein, 9 aa, Homo Sapiens
PHSPPRALV

SEQ ID NO: 1395443 - protein, 9 aa, Homo Sapiens
RMPSAGTML

SEQ ID NO: 1395444 - protein, 9 aa, Homo Sapiens
YRCRECDKA

SEQ ID NO: 1395445 - protein, 9 aa, Homo Sapiens
WQENLSKVI

SEQ ID NO: 1395446 - protein, 9 aa, Homo Sapiens
ELEQFMENE

SEQ ID NO: 1395447 - protein, 9 aa, Homo Sapiens
ITSPLNVID

SEQ ID NO: 1395448 - protein, 9 aa, Homo Sapiens
RRALHRQYG

SEQ ID NO: 1395449 - protein, 9 aa, Homo Sapiens
LIVTAASVF

SEQ ID NO: 1395450 - protein, 9 aa, Homo Sapiens
GSVCGYSGS

SEQ ID NO: 1395451 - protein, 9 aa, Homo Sapiens
VTLAPNVNM

SEQ ID NO: 1395452 - protein, 9 aa, Homo Sapiens
LFCTGKVCY

SEQ ID NO: 1395453 - protein, 9 aa, Homo Sapiens
TVAGATAQI

SEQ ID NO: 1395454 - protein, 9 aa, Homo Sapiens
PSKRRWSRS

SEQ ID NO: 1395455 - protein, 9 aa, Homo Sapiens
PTAARPSAT

SEQ ID NO: 1395456 - protein, 9 aa, Homo Sapiens
LYFYAEQGD

SEQ ID NO: 1395457 - protein, 9 aa, Homo Sapiens
AEQSPVVGQ

SEQ ID NO: 1395458 - protein, 9 aa, Homo Sapiens
SRGGTNGGS

SEQ ID NO: 1395459 - protein, 9 aa, Homo Sapiens
RDVVLMQFC

SEQ ID NO: 1395460 - protein, 9 aa, Homo Sapiens
LTPVQTLAR

SEQ ID NO: 1395461 - protein, 9 aa, Homo Sapiens
NGNSVTTAT

SEQ ID NO: 1395462 - protein, 9 aa, Homo Sapiens
VRDMLYFYA

SEQ ID NO: 1395463 - protein, 9 aa, Homo Sapiens
SEGTQTVLG

SEQ ID NO: 1395464 - protein, 9 aa, Homo Sapiens
VHDAPPPPT

SEQ ID NO: 1395465 - protein, 9 aa, Homo Sapiens
LALVGGEIT

SEQ ID NO: 1395466 - protein, 9 aa, Homo Sapiens
ESQSQDPRL

SEQ ID NO: 1395467 - protein, 9 aa, Homo Sapiens
EEAALQIPL

SEQ ID NO: 1395468 - protein, 9 aa, Homo Sapiens
HFGWTPRPH

SEQ ID NO: 1395469 - protein, 9 aa, Homo Sapiens
FFVLYYGQE

SEQ ID NO: 1395470 - protein, 9 aa, Homo Sapiens
SCNPEWLVC

SEQ ID NO: 1395471 - protein, 9 aa, Homo Sapiens
SLDDMHTDV

SEQ ID NO: 1395472 - protein, 9 aa, Homo Sapiens
CGSAACHRR

SEQ ID NO: 1395473 - protein, 9 aa, Homo Sapiens
SLFFHFPHC

SEQ ID NO: 1395474 - protein, 9 aa, Homo Sapiens
QPTAIPSDE

SEQ ID NO: 1395475 - protein, 9 aa, Homo Sapiens
RPLLQLRWP

SEQ ID NO: 1395476 - protein, 9 aa, Homo Sapiens
LRARGGTTI

SEQ ID NO: 1395477 - protein, 9 aa, Homo Sapiens
EASLRRMRT

SEQ ID NO: 1395478 - protein, 9 aa, Homo Sapiens
EKSELVNKT

SEQ ID NO: 1395479 - protein, 9 aa, Homo Sapiens
EIAAACIHM

SEQ ID NO: 1395480 - protein, 9 aa, Homo Sapiens
SLSASSPQT

SEQ ID NO: 1395481 - protein, 9 aa, Homo Sapiens
TGSDMFVNT

SEQ ID NO: 1395482 - protein, 9 aa, Homo Sapiens
PGEKGDPGQ

SEQ ID NO: 1395483 - protein, 9 aa, Homo Sapiens
FVSQINHKL

SEQ ID NO: 1395484 - protein, 9 aa, Homo Sapiens
GSVPWRLSS

SEQ ID NO: 1395485 - protein, 9 aa, Homo Sapiens
TSPLNVIDL

SEQ ID NO: 1395486 - protein, 9 aa, Homo Sapiens
GPPAGAFGE

SEQ ID NO: 1395487 - protein, 9 aa, Homo Sapiens
SSWLSRRTS

SEQ ID NO: 1395488 - protein, 9 aa, Homo Sapiens
VVNLNWKFS

SEQ ID NO: 1395489 - protein, 9 aa, Homo Sapiens
QSPVVGQVQ

SEQ ID NO: 1395490 - protein, 9 aa, Homo Sapiens
EKLVEEMLG

SEQ ID NO: 1395491 - protein, 9 aa, Homo Sapiens
QYPWKEYKS

SEQ ID NO: 1395492 - protein, 9 aa, Homo Sapiens
KCYDAQLYK

SEQ ID NO: 1395493 - protein, 9 aa, Homo Sapiens
RDLGTVAGA

SEQ ID NO: 1395494 - protein, 9 aa, Homo Sapiens
SFCIVLCMA

SEQ ID NO: 1395495 - protein, 9 aa, Homo Sapiens
AEFVNISRV

SEQ ID NO: 1395496 - protein, 9 aa, Homo Sapiens
SMFGSALQV

SEQ ID NO: 1395497 - protein, 9 aa, Homo Sapiens
PISPVIYDS

SEQ ID NO: 1395498 - protein, 9 aa, Homo Sapiens
RIHCQEVRI

SEQ ID NO: 1395499 - protein, 9 aa, Homo Sapiens
PAVPRYHVG

SEQ ID NO: 1395500 - protein, 9 aa, Homo Sapiens
IQTTGYQSI

SEQ ID NO: 1395501 - protein, 9 aa, Homo Sapiens
TCISVNTGE

SEQ ID NO: 1395502 - protein, 9 aa, Homo Sapiens
VPTATAASA

SEQ ID NO: 1395503 - protein, 9 aa, Homo Sapiens
LTEYSYPLP

SEQ ID NO: 1395504 - protein, 9 aa, Homo Sapiens
SPSRRLRSR

SEQ ID NO: 1395505 - protein, 9 aa, Homo Sapiens
RAIDGHRGQ

SEQ ID NO: 1395506 - protein, 9 aa, Homo Sapiens
LRPLLQLRW

SEQ ID NO: 1395507 - protein, 9 aa, Homo Sapiens
PPSTAATTA

SEQ ID NO: 1395508 - protein, 9 aa, Homo Sapiens
LPRASLRAT

SEQ ID NO: 1395509 - protein, 9 aa, Homo Sapiens
TNGTEEQMS

SEQ ID NO: 1395510 - protein, 9 aa, Homo Sapiens
SCGSGLGIG

SEQ ID NO: 1395511 - protein, 9 aa, Homo Sapiens
SESSQSTAP

SEQ ID NO: 1395512 - protein, 9 aa, Homo Sapiens
ASSPAPPPE

SEQ ID NO: 1395513 - protein, 9 aa, Homo Sapiens
SSRQTLQNS

SEQ ID NO: 1395514 - protein, 9 aa, Homo Sapiens
LYRSPHPSR

SEQ ID NO: 1395515 - protein, 9 aa, Homo Sapiens
IKRQKYERI

SEQ ID NO: 1395516 - protein, 9 aa, Homo Sapiens
QTPENGPET

SEQ ID NO: 1395517 - protein, 9 aa, Homo Sapiens
VCNGGMTPP

SEQ ID NO: 1395518 - protein, 9 aa, Homo Sapiens
VWGAAAAAP

SEQ ID NO: 1395519 - protein, 9 aa, Homo Sapiens
LCLMVIVIV

SEQ ID NO: 1395520 - protein, 9 aa, Homo Sapiens
PWHHWNQRG

SEQ ID NO: 1395521 - protein, 9 aa, Homo Sapiens
KPAKSCRQR

SEQ ID NO: 1395522 - protein, 9 aa, Homo Sapiens
VDGPGGPGI

SEQ ID NO: 1395523 - protein, 9 aa, Homo Sapiens
RYRPNMEGY

SEQ ID NO: 1395524 - protein, 9 aa, Homo Sapiens
SGYSIIGSP

SEQ ID NO: 1395525 - protein, 9 aa, Homo Sapiens
LDDANLCKN

SEQ ID NO: 1395526 - protein, 9 aa, Homo Sapiens
IACKVWAGL

SEQ ID NO: 1395527 - protein, 9 aa, Homo Sapiens
RVSFWSVWP

SEQ ID NO: 1395528 - protein, 9 aa, Homo Sapiens
ATFHAGTAS

SEQ ID NO: 1395529 - protein, 9 aa, Homo Sapiens
TEFLFLGLF

SEQ ID NO: 1395530 - protein, 9 aa, Homo Sapiens
RVTIYSPDG

SEQ ID NO: 1395531 - protein, 9 aa, Homo Sapiens
CPRTMAGPS

SEQ ID NO: 1395532 - protein, 9 aa, Homo Sapiens
IFLNFNPDH

SEQ ID NO: 1395533 - protein, 9 aa, Homo Sapiens
LSLVDNDLD

SEQ ID NO: 1395534 - protein, 9 aa, Homo Sapiens
EREVLMQKC

SEQ ID NO: 1395535 - protein, 9 aa, Homo Sapiens
PPLVVCRSR

SEQ ID NO: 1395536 - protein, 9 aa, Homo Sapiens
GRRVWGAAA

SEQ ID NO: 1395537 - protein, 9 aa, Homo Sapiens
AETRKESRG

SEQ ID NO: 1395538 - protein, 9 aa, Homo Sapiens
KNSESMKKV

SEQ ID NO: 1395539 - protein, 9 aa, Homo Sapiens
APTAAKPSA

SEQ ID NO: 1395540 - protein, 9 aa, Homo Sapiens
GECNHPWSI

SEQ ID NO: 1395541 - protein, 9 aa, Homo Sapiens
MISALVALV

SEQ ID NO: 1395542 - protein, 9 aa, Homo Sapiens
HVNTLSMKL

SEQ ID NO: 1395543 - protein, 9 aa, Homo Sapiens
GCPDSGMPS

SEQ ID NO: 1395544 - protein, 9 aa, Homo Sapiens
LWFTSRVQK

SEQ ID NO: 1395545 - protein, 9 aa, Homo Sapiens
LYECKQCGR

SEQ ID NO: 1395546 - protein, 9 aa, Homo Sapiens
EPEKERRPR

SEQ ID NO: 1395547 - protein, 9 aa, Homo Sapiens
QETTRMEDA

SEQ ID NO: 1395548 - protein, 9 aa, Homo Sapiens
APASSASSK

SEQ ID NO: 1395549 - protein, 9 aa, Homo Sapiens
SSLPQDVCQ

SEQ ID NO: 1395550 - protein, 9 aa, Homo Sapiens
ASHKSTSSS

SEQ ID NO: 1395551 - protein, 9 aa, Homo Sapiens
DLSPLYRSP

SEQ ID NO: 1395552 - protein, 9 aa, Homo Sapiens
RRPGNWIAH

SEQ ID NO: 1395553 - protein, 9 aa, Homo Sapiens
SSMPEQVHK

SEQ ID NO: 1395554 - protein, 9 aa, Homo Sapiens
DLSSPSDFY

SEQ ID NO: 1395555 - protein, 9 aa, Homo Sapiens
SVGGSLGQG

SEQ ID NO: 1395556 - protein, 9 aa, Homo Sapiens
PPYSESDSQ

SEQ ID NO: 1395557 - protein, 9 aa, Homo Sapiens
KTPTADPPA

SEQ ID NO: 1395558 - protein, 9 aa, Homo Sapiens
VGRLCCHHW

SEQ ID NO: 1395559 - protein, 9 aa, Homo Sapiens
MPLLHIRGD

SEQ ID NO: 1395560 - protein, 9 aa, Homo Sapiens
TADPPAQPA

SEQ ID NO: 1395561 - protein, 9 aa, Homo Sapiens
CKVWAGLSA

SEQ ID NO: 1395562 - protein, 9 aa, Homo Sapiens
CCPHSREKM

SEQ ID NO: 1395563 - protein, 9 aa, Homo Sapiens
NPSQISGLP

SEQ ID NO: 1395564 - protein, 9 aa, Homo Sapiens
PPEPEKERR

SEQ ID NO: 1395565 - protein, 9 aa, Homo Sapiens
CPDSGMPSP

SEQ ID NO: 1395566 - protein, 9 aa, Homo Sapiens
LDSFELISF

SEQ ID NO: 1395567 - protein, 9 aa, Homo Sapiens
DEMVMIMGV

SEQ ID NO: 1395568 - protein, 9 aa, Homo Sapiens
LRVDAGDQP

SEQ ID NO: 1395569 - protein, 9 aa, Homo Sapiens
LFQPPHRPG

SEQ ID NO: 1395570 - protein, 9 aa, Homo Sapiens
GGCPGLVPL

SEQ ID NO: 1395571 - protein, 9 aa, Homo Sapiens
IASLPDLPS

SEQ ID NO: 1395572 - protein, 9 aa, Homo Sapiens
PKKCPLLLV

SEQ ID NO: 1395573 - protein, 9 aa, Homo Sapiens
FQPPHRPGL

SEQ ID NO: 1395574 - protein, 9 aa, Homo Sapiens
YTFVAFGPA

SEQ ID NO: 1395575 - protein, 9 aa, Homo Sapiens
ESWEKSFVD

SEQ ID NO: 1395576 - protein, 9 aa, Homo Sapiens
GDCPRTMAG

SEQ ID NO: 1395577 - protein, 9 aa, Homo Sapiens
NIEDISEAD

SEQ ID NO: 1395578 - protein, 9 aa, Homo Sapiens
PLCSHFSRC

SEQ ID NO: 1395579 - protein, 9 aa, Homo Sapiens
YPVVDKGKQ

SEQ ID NO: 1395580 - protein, 9 aa, Homo Sapiens
SQSTAPSPS

SEQ ID NO: 1395581 - protein, 9 aa, Homo Sapiens
PRFSSPSSC

SEQ ID NO: 1395582 - protein, 9 aa, Homo Sapiens
EVHAQYEEI

SEQ ID NO: 1395583 - protein, 9 aa, Homo Sapiens
LYEMPVPAC

SEQ ID NO: 1395584 - protein, 9 aa, Homo Sapiens
YGKCFPFQG

SEQ ID NO: 1395585 - protein, 9 aa, Homo Sapiens
YLAHNAKDV

SEQ ID NO: 1395586 - protein, 9 aa, Homo Sapiens
LLCAYVAIF

SEQ ID NO: 1395587 - protein, 9 aa, Homo Sapiens
TKDRLIKIM

SEQ ID NO: 1395588 - protein, 9 aa, Homo Sapiens
NPSSHRVLV

SEQ ID NO: 1395589 - protein, 9 aa, Homo Sapiens
RYRGPPGPQ

SEQ ID NO: 1395590 - protein, 9 aa, Homo Sapiens
RKIFETLRI

SEQ ID NO: 1395591 - protein, 9 aa, Homo Sapiens
TTAELFVLS

SEQ ID NO: 1395592 - protein, 9 aa, Homo Sapiens
SWISSQTRY

SEQ ID NO: 1395593 - protein, 9 aa, Homo Sapiens
HKELQELSS

SEQ ID NO: 1395594 - protein, 9 aa, Homo Sapiens
YGGAHPTPP

SEQ ID NO: 1395595 - protein, 9 aa, Homo Sapiens
QFIPTTEGV

SEQ ID NO: 1395596 - protein, 9 aa, Homo Sapiens
EVPADDEDG

SEQ ID NO: 1395597 - protein, 9 aa, Homo Sapiens
DPSMTTSCL

SEQ ID NO: 1395598 - protein, 9 aa, Homo Sapiens
PASLFQPPH

SEQ ID NO: 1395599 - protein, 9 aa, Homo Sapiens
LAEERQEIL

SEQ ID NO: 1395600 - protein, 9 aa, Homo Sapiens
MFLIQRELL

SEQ ID NO: 1395601 - protein, 9 aa, Homo Sapiens
GRSGVLTEK

SEQ ID NO: 1395602 - protein, 9 aa, Homo Sapiens
MNIQEDILS

SEQ ID NO: 1395603 - protein, 9 aa, Homo Sapiens
KIPIGWAAL

SEQ ID NO: 1395604 - protein, 9 aa, Homo Sapiens
HFSRCSWIS

SEQ ID NO: 1395605 - protein, 9 aa, Homo Sapiens
SRRAPSCTA

SEQ ID NO: 1395606 - protein, 9 aa, Homo Sapiens
SATNPTWRR

SEQ ID NO: 1395607 - protein, 9 aa, Homo Sapiens
REERRRECR

SEQ ID NO: 1395608 - protein, 9 aa, Homo Sapiens
GVKTVMITW

SEQ ID NO: 1395609 - protein, 9 aa, Homo Sapiens
VVEEEKLLK

SEQ ID NO: 1395610 - protein, 9 aa, Homo Sapiens
RGSNSWVNS

SEQ ID NO: 1395611 - protein, 9 aa, Homo Sapiens
VGCTNVRDS

SEQ ID NO: 1395612 - protein, 9 aa, Homo Sapiens
CDKAFNHSA

SEQ ID NO: 1395613 - protein, 9 aa, Homo Sapiens
SRRLRSRLP

SEQ ID NO: 1395614 - protein, 9 aa, Homo Sapiens
CHLRTRIDR

SEQ ID NO: 1395615 - protein, 9 aa, Homo Sapiens
STRASGPTP

SEQ ID NO: 1395616 - protein, 9 aa, Homo Sapiens
LEYDESVED

SEQ ID NO: 1395617 - protein, 9 aa, Homo Sapiens
EMGHGGTHA

SEQ ID NO: 1395618 - protein, 9 aa, Homo Sapiens
WPVESHPHG

SEQ ID NO: 1395619 - protein, 9 aa, Homo Sapiens
KGITEKSNM

SEQ ID NO: 1395620 - protein, 9 aa, Homo Sapiens
EDAGFQQQT

SEQ ID NO: 1395621 - protein, 9 aa, Homo Sapiens
PLGSEGCIP

SEQ ID NO: 1395622 - protein, 9 aa, Homo Sapiens
INDVGPVDA

SEQ ID NO: 1395623 - protein, 9 aa, Homo Sapiens
YYYRETYCA

SEQ ID NO: 1395624 - protein, 9 aa, Homo Sapiens
ELERTISSC

SEQ ID NO: 1395625 - protein, 9 aa, Homo Sapiens
KLGSARRSR

SEQ ID NO: 1395626 - protein, 9 aa, Homo Sapiens
TDRALQASY

SEQ ID NO: 1395627 - protein, 9 aa, Homo Sapiens
RAWGRLCVD

SEQ ID NO: 1395628 - protein, 9 aa, Homo Sapiens
LTRIACKVW

SEQ ID NO: 1395629 - protein, 9 aa, Homo Sapiens
GLYNFSDGL

SEQ ID NO: 1395630 - protein, 9 aa, Homo Sapiens
EPTWLERQE

SEQ ID NO: 1395631 - protein, 9 aa, Homo Sapiens
ISCTDSSVN

SEQ ID NO: 1395632 - protein, 9 aa, Homo Sapiens
LATSSQDMI

SEQ ID NO: 1395633 - protein, 9 aa, Homo Sapiens
NTGQLVFLA

SEQ ID NO: 1395634 - protein, 9 aa, Homo Sapiens
TAIPSDETA

SEQ ID NO: 1395635 - protein, 9 aa, Homo Sapiens
GPVEAAIHT

SEQ ID NO: 1395636 - protein, 9 aa, Homo Sapiens
RGMGGQPRE

SEQ ID NO: 1395637 - protein, 9 aa, Homo Sapiens
AAIHTKLEE

SEQ ID NO: 1395638 - protein, 9 aa, Homo Sapiens
AEERQEILP

SEQ ID NO: 1395639 - protein, 9 aa, Homo Sapiens
KRETIVLQH

SEQ ID NO: 1395640 - protein, 9 aa, Homo Sapiens
LLGYPVVDK

SEQ ID NO: 1395641 - protein, 9 aa, Homo Sapiens
KPKAQTMNS

SEQ ID NO: 1395642 - protein, 9 aa, Homo Sapiens
HHSVSCSNI

SEQ ID NO: 1395643 - protein, 9 aa, Homo Sapiens
LLHNHYGGK

SEQ ID NO: 1395644 - protein, 9 aa, Homo Sapiens
PGLVPLPLC

SEQ ID NO: 1395645 - protein, 9 aa, Homo Sapiens
DESVEDANP

SEQ ID NO: 1395646 - protein, 9 aa, Homo Sapiens
SRWTEASLR

SEQ ID NO: 1395647 - protein, 9 aa, Homo Sapiens
RQLMHLRGD

SEQ ID NO: 1395648 - protein, 9 aa, Homo Sapiens
LDFAASQVV

SEQ ID NO: 1395649 - protein, 9 aa, Homo Sapiens
KREKKNQKR

SEQ ID NO: 1395650 - protein, 9 aa, Homo Sapiens
AVPSVARPS

SEQ ID NO: 1395651 - protein, 9 aa, Homo Sapiens
PPPAVGARR

SEQ ID NO: 1395652 - protein, 9 aa, Homo Sapiens
RLRACRAGG

SEQ ID NO: 1395653 - protein, 9 aa, Homo Sapiens
PLPLCGYPG

SEQ ID NO: 1395654 - protein, 9 aa, Homo Sapiens
LHVNTLSMK

SEQ ID NO: 1395655 - protein, 9 aa, Homo Sapiens
WKIPIGWAA

SEQ ID NO: 1395656 - protein, 9 aa, Homo Sapiens
ASGGAWKSI

SEQ ID NO: 1395657 - protein, 9 aa, Homo Sapiens
GCHSHHQRS

SEQ ID NO: 1395658 - protein, 9 aa, Homo Sapiens
LTILDDEPV

SEQ ID NO: 1395659 - protein, 9 aa, Homo Sapiens
GEKWMDRYK

SEQ ID NO: 1395660 - protein, 9 aa, Homo Sapiens
ASTTHKELQ

SEQ ID NO: 1395661 - protein, 9 aa, Homo Sapiens
GPTVPDLPP

SEQ ID NO: 1395662 - protein, 9 aa, Homo Sapiens
PSQQLRKPR

SEQ ID NO: 1395663 - protein, 9 aa, Homo Sapiens
TSAPTAAKP

SEQ ID NO: 1395664 - protein, 9 aa, Homo Sapiens
AGALSQDAL

SEQ ID NO: 1395665 - protein, 9 aa, Homo Sapiens
QSSSSSRPP

SEQ ID NO: 1395666 - protein, 9 aa, Homo Sapiens
SKRIKSAAM

SEQ ID NO: 1395667 - protein, 9 aa, Homo Sapiens
HLWTSLKQM

SEQ ID NO: 1395668 - protein, 9 aa, Homo Sapiens
LASGAPGLA

SEQ ID NO: 1395669 - protein, 9 aa, Homo Sapiens
LVARGMGGS

SEQ ID NO: 1395670 - protein, 9 aa, Homo Sapiens
WFQNWRMKM

SEQ ID NO: 1395671 - protein, 9 aa, Homo Sapiens
TSGKAKSHC

SEQ ID NO: 1395672 - protein, 9 aa, Homo Sapiens
MDEIGNHYM

SEQ ID NO: 1395673 - protein, 9 aa, Homo Sapiens
RYHVGCTNV

SEQ ID NO: 1395674 - protein, 9 aa, Homo Sapiens
ASMSFGATS

SEQ ID NO: 1395675 - protein, 9 aa, Homo Sapiens
IIMALGALL

SEQ ID NO: 1395676 - protein, 9 aa, Homo Sapiens
AQVYFTQES

SEQ ID NO: 1395677 - protein, 9 aa, Homo Sapiens
KQVETQSLA

SEQ ID NO: 1395678 - protein, 9 aa, Homo Sapiens
DPMLSPSAF

SEQ ID NO: 1395679 - protein, 9 aa, Homo Sapiens
EAHYYQLQP

SEQ ID NO: 1395680 - protein, 9 aa, Homo Sapiens
ALKDEEEKV

SEQ ID NO: 1395681 - protein, 9 aa, Homo Sapiens
PPPTPASGG

SEQ ID NO: 1395682 - protein, 9 aa, Homo Sapiens
HLWLSHRLR

SEQ ID NO: 1395683 - protein, 9 aa, Homo Sapiens
IFGKHIILF

SEQ ID NO: 1395684 - protein, 9 aa, Homo Sapiens
SFMGIFELE

SEQ ID NO: 1395685 - protein, 9 aa, Homo Sapiens
PSCTARAPL

SEQ ID NO: 1395686 - protein, 9 aa, Homo Sapiens
SFSWRAGSS

SEQ ID NO: 1395687 - protein, 9 aa, Homo Sapiens
TKFQLIIIP

SEQ ID NO: 1395688 - protein, 9 aa, Homo Sapiens
EQVEIAEKM

SEQ ID NO: 1395689 - protein, 9 aa, Homo Sapiens
SGLKNIPGI

SEQ ID NO: 1395690 - protein, 9 aa, Homo Sapiens
SSFSWRAGS

SEQ ID NO: 1395691 - protein, 9 aa, Homo Sapiens
KGSVLWMSP

SEQ ID NO: 1395692 - protein, 9 aa, Homo Sapiens
IPTGSRRNG

SEQ ID NO: 1395693 - protein, 9 aa, Homo Sapiens
FSALLCYDR

SEQ ID NO: 1395694 - protein, 9 aa, Homo Sapiens
NCIPAPVPV

SEQ ID NO: 1395695 - protein, 9 aa, Homo Sapiens
TWLISLADY

SEQ ID NO: 1395696 - protein, 9 aa, Homo Sapiens
HNSVKNSST

SEQ ID NO: 1395697 - protein, 9 aa, Homo Sapiens
SGSTPGSGP

SEQ ID NO: 1395698 - protein, 9 aa, Homo Sapiens
RAWWQENLS

SEQ ID NO: 1395699 - protein, 9 aa, Homo Sapiens
KLGIRGSWM

SEQ ID NO: 1395700 - protein, 9 aa, Homo Sapiens
QEAEDYPFG

SEQ ID NO: 1395701 - protein, 9 aa, Homo Sapiens
LDSSAPRHH

SEQ ID NO: 1395702 - protein, 9 aa, Homo Sapiens
RASFNYLRL

SEQ ID NO: 1395703 - protein, 9 aa, Homo Sapiens
QKQVETQSL

SEQ ID NO: 1395704 - protein, 9 aa, Homo Sapiens
SEPKEEEED

SEQ ID NO: 1395705 - protein, 9 aa, Homo Sapiens
GTTCDIQTH

SEQ ID NO: 1395706 - protein, 9 aa, Homo Sapiens
TLTEYARPH

SEQ ID NO: 1395707 - protein, 9 aa, Homo Sapiens
DTKLPASRS

SEQ ID NO: 1395708 - protein, 9 aa, Homo Sapiens
KTDPNSRIC

SEQ ID NO: 1395709 - protein, 9 aa, Homo Sapiens
SAGYRSCAV

SEQ ID NO: 1395710 - protein, 9 aa, Homo Sapiens
VAERLEAME

SEQ ID NO: 1395711 - protein, 9 aa, Homo Sapiens
WLLSGRVAV

SEQ ID NO: 1395712 - protein, 9 aa, Homo Sapiens
LSQKLCNSQ

SEQ ID NO: 1395713 - protein, 9 aa, Homo Sapiens
KDLPATLCL

SEQ ID NO: 1395714 - protein, 9 aa, Homo Sapiens
LPKFTSLAT

SEQ ID NO: 1395715 - protein, 9 aa, Homo Sapiens
TNPTWRRTG

SEQ ID NO: 1395716 - protein, 9 aa, Homo Sapiens
LSPLTEGPP

SEQ ID NO: 1395717 - protein, 9 aa, Homo Sapiens
GNNLTHLPN

SEQ ID NO: 1395718 - protein, 9 aa, Homo Sapiens
LRWPGLPGP

SEQ ID NO: 1395719 - protein, 9 aa, Homo Sapiens
PGDTSEVSL

SEQ ID NO: 1395720 - protein, 9 aa, Homo Sapiens
EEKVLQLTV

SEQ ID NO: 1395721 - protein, 9 aa, Homo Sapiens
KCPLLLVYI

SEQ ID NO: 1395722 - protein, 9 aa, Homo Sapiens
EPYCIIAAV

SEQ ID NO: 1395723 - protein, 9 aa, Homo Sapiens
AICHPLHYN

SEQ ID NO: 1395724 - protein, 9 aa, Homo Sapiens
EYKLQVPRI

SEQ ID NO: 1395725 - protein, 9 aa, Homo Sapiens
APHTRLWMA

SEQ ID NO: 1395726 - protein, 9 aa, Homo Sapiens
VCSQGSLFV

SEQ ID NO: 1395727 - protein, 9 aa, Homo Sapiens
GGQPREPGR

SEQ ID NO: 1395728 - protein, 9 aa, Homo Sapiens
WNRLREGQT

SEQ ID NO: 1395729 - protein, 9 aa, Homo Sapiens
QDYPDSQLP

SEQ ID NO: 1395730 - protein, 9 aa, Homo Sapiens
MWVMSRACP

SEQ ID NO: 1395731 - protein, 9 aa, Homo Sapiens
NKPPSRHVG

SEQ ID NO: 1395732 - protein, 9 aa, Homo Sapiens
GQPREPGRP

SEQ ID NO: 1395733 - protein, 9 aa, Homo Sapiens
LYYLVTFWE

SEQ ID NO: 1395734 - protein, 9 aa, Homo Sapiens
RVVYASTTG

SEQ ID NO: 1395735 - protein, 9 aa, Homo Sapiens
CWISSSLSL

SEQ ID NO: 1395736 - protein, 9 aa, Homo Sapiens
ATAASARSP

SEQ ID NO: 1395737 - protein, 9 aa, Homo Sapiens
AGRSGVLTE

SEQ ID NO: 1395738 - protein, 9 aa, Homo Sapiens
THKELQELS

SEQ ID NO: 1395739 - protein, 9 aa, Homo Sapiens
EAFNCFFTS

SEQ ID NO: 1395740 - protein, 9 aa, Homo Sapiens
EGTQTVLGP

SEQ ID NO: 1395741 - protein, 9 aa, Homo Sapiens
LRDNHLEIW

SEQ ID NO: 1395742 - protein, 9 aa, Homo Sapiens
LLLCAYVAI

SEQ ID NO: 1395743 - protein, 9 aa, Homo Sapiens
TSECMTAHS

SEQ ID NO: 1395744 - protein, 9 aa, Homo Sapiens
PETPANRYR

SEQ ID NO: 1395745 - protein, 9 aa, Homo Sapiens
FTSLATAWE

SEQ ID NO: 1395746 - protein, 9 aa, Homo Sapiens
PPHRPGLGT

SEQ ID NO: 1395747 - protein, 9 aa, Homo Sapiens
RDSLGAKGR

SEQ ID NO: 1395748 - protein, 9 aa, Homo Sapiens
LKDEEEKVL

SEQ ID NO: 1395749 - protein, 9 aa, Homo Sapiens
GLKYVTYRN

SEQ ID NO: 1395750 - protein, 9 aa, Homo Sapiens
CRVPAPLLT

SEQ ID NO: 1395751 - protein, 9 aa, Homo Sapiens
KRLEKPSAL

SEQ ID NO: 1395752 - protein, 9 aa, Homo Sapiens
WNQRGSHWS

SEQ ID NO: 1395753 - protein, 9 aa, Homo Sapiens
MDFLMSHPR

SEQ ID NO: 1395754 - protein, 9 aa, Homo Sapiens
FPLCPWLPQ

SEQ ID NO: 1395755 - protein, 9 aa, Homo Sapiens
GYTCDYVGG

SEQ ID NO: 1395756 - protein, 9 aa, Homo Sapiens
PDIGGSGRG

SEQ ID NO: 1395757 - protein, 9 aa, Homo Sapiens
SQLRGSSPV

SEQ ID NO: 1395758 - protein, 9 aa, Homo Sapiens
DWWGPSRDS

SEQ ID NO: 1395759 - protein, 9 aa, Homo Sapiens
LPNGLLGAQ

SEQ ID NO: 1395760 - protein, 9 aa, Homo Sapiens
AQCPLLDCR

SEQ ID NO: 1395761 - protein, 9 aa, Homo Sapiens
RVLARHDIR

SEQ ID NO: 1395762 - protein, 9 aa, Homo Sapiens
SGRVAVVPL

SEQ ID NO: 1395763 - protein, 9 aa, Homo Sapiens
EAPPPSTAA

SEQ ID NO: 1395764 - protein, 9 aa, Homo Sapiens
RSSWNRLRE

SEQ ID NO: 1395765 - protein, 9 aa, Homo Sapiens
ILRVILEVL

SEQ ID NO: 1395766 - protein, 9 aa, Homo Sapiens
AAARKPHSP

SEQ ID NO: 1395767 - protein, 9 aa, Homo Sapiens
LPSPRPPPL

SEQ ID NO: 1395768 - protein, 9 aa, Homo Sapiens
ENPGAIEAS

SEQ ID NO: 1395769 - protein, 9 aa, Homo Sapiens
KAQFVSQIN

SEQ ID NO: 1395770 - protein, 9 aa, Homo Sapiens
VTYRNIRER

SEQ ID NO: 1395771 - protein, 9 aa, Homo Sapiens
EHLWTSLKQ

SEQ ID NO: 1395772 - protein, 9 aa, Homo Sapiens
GCSLGSRLH

SEQ ID NO: 1395773 - protein, 9 aa, Homo Sapiens
PRQPSQQLR

SEQ ID NO: 1395774 - protein, 9 aa, Homo Sapiens
QAVGAERVL

SEQ ID NO: 1395775 - protein, 9 aa, Homo Sapiens
AGFLFLSGH

SEQ ID NO: 1395776 - protein, 9 aa, Homo Sapiens
LKELREREY

SEQ ID NO: 1395777 - protein, 9 aa, Homo Sapiens
FLEHFLISA

SEQ ID NO: 1395778 - protein, 9 aa, Homo Sapiens
GPPPSPSRR

SEQ ID NO: 1395779 - protein, 9 aa, Homo Sapiens
CGGAGGGGP

SEQ ID NO: 1395780 - protein, 9 aa, Homo Sapiens
GVFSFGTRA

SEQ ID NO: 1395781 - protein, 9 aa, Homo Sapiens
SETTVMSLG

SEQ ID NO: 1395782 - protein, 9 aa, Homo Sapiens
PILNAEELN

SEQ ID NO: 1395783 - protein, 9 aa, Homo Sapiens
LARVVYAST

SEQ ID NO: 1395784 - protein, 9 aa, Homo Sapiens
FYDNCCRLW

SEQ ID NO: 1395785 - protein, 9 aa, Homo Sapiens
HHLVSMKSI

SEQ ID NO: 1395786 - protein, 9 aa, Homo Sapiens
QRFCGREYV

SEQ ID NO: 1395787 - protein, 9 aa, Homo Sapiens
EVTQVPLVS

SEQ ID NO: 1395788 - protein, 9 aa, Homo Sapiens
VLLGYPVVD

SEQ ID NO: 1395789 - protein, 9 aa, Homo Sapiens
SGGSPISPV

SEQ ID NO: 1395790 - protein, 9 aa, Homo Sapiens
LPQQRFCGR

SEQ ID NO: 1395791 - protein, 9 aa, Homo Sapiens
RTLEGCISV

SEQ ID NO: 1395792 - protein, 9 aa, Homo Sapiens
CDFIDNLDS

SEQ ID NO: 1395793 - protein, 9 aa, Homo Sapiens
VFWALILVT

SEQ ID NO: 1395794 - protein, 9 aa, Homo Sapiens
LCLICCGYI

SEQ ID NO: 1395795 - protein, 9 aa, Homo Sapiens
WPGLPGPTV

SEQ ID NO: 1395796 - protein, 9 aa, Homo Sapiens
PWRLSSLPC

SEQ ID NO: 1395797 - protein, 9 aa, Homo Sapiens
VVHLVLHRL

SEQ ID NO: 1395798 - protein, 9 aa, Homo Sapiens
AVEFHYFQQ

SEQ ID NO: 1395799 - protein, 9 aa, Homo Sapiens
EAHFQDVRG

SEQ ID NO: 1395800 - protein, 9 aa, Homo Sapiens
RATRIACAH

SEQ ID NO: 1395801 - protein, 9 aa, Homo Sapiens
IWLQINKPT

SEQ ID NO: 1395802 - protein, 9 aa, Homo Sapiens
QTILLAYGE

SEQ ID NO: 1395803 - protein, 9 aa, Homo Sapiens
DCPLDSKDL

SEQ ID NO: 1395804 - protein, 9 aa, Homo Sapiens
RTSLSARRK

SEQ ID NO: 1395805 - protein, 9 aa, Homo Sapiens
TIPVTVLKS

SEQ ID NO: 1395806 - protein, 9 aa, Homo Sapiens
SSVLRSWQL

SEQ ID NO: 1395807 - protein, 9 aa, Homo Sapiens
VTTSRCCPP

SEQ ID NO: 1395808 - protein, 9 aa, Homo Sapiens
QANLEHSLL

SEQ ID NO: 1395809 - protein, 9 aa, Homo Sapiens
LLCSGQGTA

SEQ ID NO: 1395810 - protein, 9 aa, Homo Sapiens
MYTQMPNTA

SEQ ID NO: 1395811 - protein, 9 aa, Homo Sapiens
TVMITWKEI

SEQ ID NO: 1395812 - protein, 9 aa, Homo Sapiens
LPTANGLHL

SEQ ID NO: 1395813 - protein, 9 aa, Homo Sapiens
HIRGDDSGA

SEQ ID NO: 1395814 - protein, 9 aa, Homo Sapiens
VLYYGQEVL

SEQ ID NO: 1395815 - protein, 9 aa, Homo Sapiens
APLRPLSGP

SEQ ID NO: 1395816 - protein, 9 aa, Homo Sapiens
LLAGSRTPI

SEQ ID NO: 1395817 - protein, 9 aa, Homo Sapiens
KPSALDYKI

SEQ ID NO: 1395818 - protein, 9 aa, Homo Sapiens
SEQDTSECM

SEQ ID NO: 1395819 - protein, 9 aa, Homo Sapiens
DGPPDRDPM

SEQ ID NO: 1395820 - protein, 9 aa, Homo Sapiens
CQKEQSLWK

SEQ ID NO: 1395821 - protein, 9 aa, Homo Sapiens
ICDRGFVLM

SEQ ID NO: 1395822 - protein, 9 aa, Homo Sapiens
GSQRAVRGT

SEQ ID NO: 1395823 - protein, 9 aa, Homo Sapiens
AAIWRRIGA

SEQ ID NO: 1395824 - protein, 9 aa, Homo Sapiens
YPFGPVENK

SEQ ID NO: 1395825 - protein, 9 aa, Homo Sapiens
GQGTASPTT

SEQ ID NO: 1395826 - protein, 9 aa, Homo Sapiens
ATGLHLHRQ

SEQ ID NO: 1395827 - protein, 9 aa, Homo Sapiens
SFVDNFVSR

SEQ ID NO: 1395828 - protein, 9 aa, Homo Sapiens
EKLDPQPFL

SEQ ID NO: 1395829 - protein, 9 aa, Homo Sapiens
GNSVTTATQ

SEQ ID NO: 1395830 - protein, 9 aa, Homo Sapiens
LVGGEITDD

SEQ ID NO: 1395831 - protein, 9 aa, Homo Sapiens
TPNFSALLC

SEQ ID NO: 1395832 - protein, 9 aa, Homo Sapiens
WTCPRKAHP

SEQ ID NO: 1395833 - protein, 9 aa, Homo Sapiens
SLFQPPHRP

SEQ ID NO: 1395834 - protein, 9 aa, Homo Sapiens
APSAVPSVA

SEQ ID NO: 1395835 - protein, 9 aa, Homo Sapiens
EKRHKKQSQ

SEQ ID NO: 1395836 - protein, 9 aa, Homo Sapiens
TPRGAGSYI

SEQ ID NO: 1395837 - protein, 9 aa, Homo Sapiens
FGLLLLSPA

SEQ ID NO: 1395838 - protein, 9 aa, Homo Sapiens
HIMQYGNKT

SEQ ID NO: 1395839 - protein, 9 aa, Homo Sapiens
ARPSTTRRD

SEQ ID NO: 1395840 - protein, 9 aa, Homo Sapiens
LPPPHLRQL

SEQ ID NO: 1395841 - protein, 9 aa, Homo Sapiens
APSDKPPNP

SEQ ID NO: 1395842 - protein, 9 aa, Homo Sapiens
QDVIGKTDP

SEQ ID NO: 1395843 - protein, 9 aa, Homo Sapiens
HLVLHRLLQ

SEQ ID NO: 1395844 - protein, 9 aa, Homo Sapiens
ANIEDISEA

SEQ ID NO: 1395845 - protein, 9 aa, Homo Sapiens
EEEEGIYRW

SEQ ID NO: 1395846 - protein, 9 aa, Homo Sapiens
QNHSKCITE

SEQ ID NO: 1395847 - protein, 9 aa, Homo Sapiens
EERDQKREK

SEQ ID NO: 1395848 - protein, 9 aa, Homo Sapiens
SLQKICSLL

SEQ ID NO: 1395849 - protein, 9 aa, Homo Sapiens
APLPKCRVP

SEQ ID NO: 1395850 - protein, 9 aa, Homo Sapiens
QQRFCGREY

SEQ ID NO: 1395851 - protein, 9 aa, Homo Sapiens
RPAWCCSWH

SEQ ID NO: 1395852 - protein, 9 aa, Homo Sapiens
DKYPIQDTK

SEQ ID NO: 1395853 - protein, 9 aa, Homo Sapiens
PVTKTITTP

SEQ ID NO: 1395854 - protein, 9 aa, Homo Sapiens
SNLNTTCLF

SEQ ID NO: 1395855 - protein, 9 aa, Homo Sapiens
VVVMQRELT

SEQ ID NO: 1395856 - protein, 9 aa, Homo Sapiens
KEKKKKKTS

SEQ ID NO: 1395857 - protein, 9 aa, Homo Sapiens
SWQPACGAL

SEQ ID NO: 1395858 - protein, 9 aa, Homo Sapiens
SGWLYCMKV

SEQ ID NO: 1395859 - protein, 9 aa, Homo Sapiens
GSARSLGIC

SEQ ID NO: 1395860 - protein, 9 aa, Homo Sapiens
VGFIHQAST

SEQ ID NO: 1395861 - protein, 9 aa, Homo Sapiens
TASVGGSLG

SEQ ID NO: 1395862 - protein, 9 aa, Homo Sapiens
EAEDYPFGP

SEQ ID NO: 1395863 - protein, 9 aa, Homo Sapiens
WHLPTISRG

SEQ ID NO: 1395864 - protein, 9 aa, Homo Sapiens
LLYYLVTFW

SEQ ID NO: 1395865 - protein, 9 aa, Homo Sapiens
RSCQNINEC

SEQ ID NO: 1395866 - protein, 9 aa, Homo Sapiens
RKNLIPCGP

SEQ ID NO: 1395867 - protein, 9 aa, Homo Sapiens
TSGTAPSAV

SEQ ID NO: 1395868 - protein, 9 aa, Homo Sapiens
SSWQVLFMN

SEQ ID NO: 1395869 - protein, 9 aa, Homo Sapiens
KCSLYGKKL

SEQ ID NO: 1395870 - protein, 9 aa, Homo Sapiens
EDLKIYLQT

SEQ ID NO: 1395871 - protein, 9 aa, Homo Sapiens
CKPNFFVTL

SEQ ID NO: 1395872 - protein, 9 aa, Homo Sapiens
PREVRRLPK

SEQ ID NO: 1395873 - protein, 9 aa, Homo Sapiens
LCHKAQFVS

SEQ ID NO: 1395874 - protein, 9 aa, Homo Sapiens
TAPSPSVLL

SEQ ID NO: 1395875 - protein, 9 aa, Homo Sapiens
IDVYGNTAL

SEQ ID NO: 1395876 - protein, 9 aa, Homo Sapiens
KSGGEEAAA

SEQ ID NO: 1395877 - protein, 9 aa, Homo Sapiens
NLPVQPVTK

SEQ ID NO: 1395878 - protein, 9 aa, Homo Sapiens
LNFNPDHIR

SEQ ID NO: 1395879 - protein, 9 aa, Homo Sapiens
FFQMVISNP

SEQ ID NO: 1395880 - protein, 9 aa, Homo Sapiens
IGATTPPIG

SEQ ID NO: 1395881 - protein, 9 aa, Homo Sapiens
ASMRPDGRP

SEQ ID NO: 1395882 - protein, 9 aa, Homo Sapiens
EPSLRSSWN

SEQ ID NO: 1395883 - protein, 9 aa, Homo Sapiens
FGYTFVAFG

SEQ ID NO: 1395884 - protein, 9 aa, Homo Sapiens
GESQRWKIP

SEQ ID NO: 1395885 - protein, 9 aa, Homo Sapiens
SRGLPRAWG

SEQ ID NO: 1395886 - protein, 9 aa, Homo Sapiens
DNCCRLWCF

SEQ ID NO: 1395887 - protein, 9 aa, Homo Sapiens
IQVLTYEWR

SEQ ID NO: 1395888 - protein, 9 aa, Homo Sapiens
LVSVGGGDV

SEQ ID NO: 1395889 - protein, 9 aa, Homo Sapiens
RSCAVNKGQ

SEQ ID NO: 1395890 - protein, 9 aa, Homo Sapiens
SCPPLLEAF

SEQ ID NO: 1395891 - protein, 9 aa, Homo Sapiens
GPAGWARQA

SEQ ID NO: 1395892 - protein, 9 aa, Homo Sapiens
LVRDMLYFY

SEQ ID NO: 1395893 - protein, 9 aa, Homo Sapiens
WGCPFIETS

SEQ ID NO: 1395894 - protein, 9 aa, Homo Sapiens
KEDKKIEEK

SEQ ID NO: 1395895 - protein, 9 aa, Homo Sapiens
MPRTLEGCI

SEQ ID NO: 1395896 - protein, 9 aa, Homo Sapiens
FYWHCGSAA

SEQ ID NO: 1395897 - protein, 9 aa, Homo Sapiens
CLLPVWPAL

SEQ ID NO: 1395898 - protein, 9 aa, Homo Sapiens
RPEQLPQHA

SEQ ID NO: 1395899 - protein, 9 aa, Homo Sapiens
QRAVRGTSP

SEQ ID NO: 1395900 - protein, 9 aa, Homo Sapiens
FLHEVVKMH

SEQ ID NO: 1395901 - protein, 9 aa, Homo Sapiens
SKVLNKKKC

SEQ ID NO: 1395902 - protein, 9 aa, Homo Sapiens
WPRGEQESQ

SEQ ID NO: 1395903 - protein, 9 aa, Homo Sapiens
VVKFFLQLQ

SEQ ID NO: 1395904 - protein, 9 aa, Homo Sapiens
TTNTYISLI

SEQ ID NO: 1395905 - protein, 9 aa, Homo Sapiens
GPKAPCPGT

SEQ ID NO: 1395906 - protein, 9 aa, Homo Sapiens
PKPAKSCRQ

SEQ ID NO: 1395907 - protein, 9 aa, Homo Sapiens
ETPNSTPPQ

SEQ ID NO: 1395908 - protein, 9 aa, Homo Sapiens
RQEILPDEI

SEQ ID NO: 1395909 - protein, 9 aa, Homo Sapiens
GYYYRETYC

SEQ ID NO: 1395910 - protein, 9 aa, Homo Sapiens
HVGCTNVRD

SEQ ID NO: 1395911 - protein, 9 aa, Homo Sapiens
ITLLPRAAP

SEQ ID NO: 1395912 - protein, 9 aa, Homo Sapiens
LRGSSPVGR

SEQ ID NO: 1395913 - protein, 9 aa, Homo Sapiens
ASRLSTSAP

SEQ ID NO: 1395914 - protein, 9 aa, Homo Sapiens
LSRASFNYL

SEQ ID NO: 1395915 - protein, 9 aa, Homo Sapiens
SSKVVHIMT

SEQ ID NO: 1395916 - protein, 9 aa, Homo Sapiens
IMSTLAEFV

SEQ ID NO: 1395917 - protein, 9 aa, Homo Sapiens
LLSLDDMHT

SEQ ID NO: 1395918 - protein, 9 aa, Homo Sapiens
KQQQVDIPI

SEQ ID NO: 1395919 - protein, 9 aa, Homo Sapiens
GSPLMSEFR

SEQ ID NO: 1395920 - protein, 9 aa, Homo Sapiens
WTSWRTKEQ

SEQ ID NO: 1395921 - protein, 9 aa, Homo Sapiens
ASPAVAVPT

SEQ ID NO: 1395922 - protein, 9 aa, Homo Sapiens
VTWLISLAD

SEQ ID NO: 1395923 - protein, 9 aa, Homo Sapiens
QVDIPIRLL

SEQ ID NO: 1395924 - protein, 9 aa, Homo Sapiens
NYYMMDFLM

SEQ ID NO: 1395925 - protein, 9 aa, Homo Sapiens
SMTTSCLKF

SEQ ID NO: 1395926 - protein, 9 aa, Homo Sapiens
DHRTSQNHS

SEQ ID NO: 1395927 - protein, 9 aa, Homo Sapiens
PPQVPTSLP

SEQ ID NO: 1395928 - protein, 9 aa, Homo Sapiens
IGVKTVMIT

SEQ ID NO: 1395929 - protein, 9 aa, Homo Sapiens
SDHGCPSQL

SEQ ID NO: 1395930 - protein, 9 aa, Homo Sapiens
EAARIIYPQ

SEQ ID NO: 1395931 - protein, 9 aa, Homo Sapiens
HSAWCVYQY

SEQ ID NO: 1395932 - protein, 9 aa, Homo Sapiens
MASMSFGAT

SEQ ID NO: 1395933 - protein, 9 aa, Homo Sapiens
RPSATNPTW

SEQ ID NO: 1395934 - protein, 9 aa, Homo Sapiens
KAELLLSQY

SEQ ID NO: 1395935 - protein, 9 aa, Homo Sapiens
SSSPTGGGS

SEQ ID NO: 1395936 - protein, 9 aa, Homo Sapiens
LGTVAGATA

SEQ ID NO: 1395937 - protein, 9 aa, Homo Sapiens
KLPKAEECD

SEQ ID NO: 1395938 - protein, 9 aa, Homo Sapiens
GSSYSCGSG

SEQ ID NO: 1395939 - protein, 9 aa, Homo Sapiens
DACSCGVTG

SEQ ID NO: 1395940 - protein, 9 aa, Homo Sapiens
KGIQVTATN

SEQ ID NO: 1395941 - protein, 9 aa, Homo Sapiens
TSAPTMAAA

SEQ ID NO: 1395942 - protein, 9 aa, Homo Sapiens
AVTATSANL

SEQ ID NO: 1395943 - protein, 9 aa, Homo Sapiens
IGAELDDDQ

SEQ ID NO: 1395944 - protein, 9 aa, Homo Sapiens
PLSVPTILY

SEQ ID NO: 1395945 - protein, 9 aa, Homo Sapiens
LYEEAHYYQ

SEQ ID NO: 1395946 - protein, 9 aa, Homo Sapiens
GPATFHAGT

SEQ ID NO: 1395947 - protein, 9 aa, Homo Sapiens
RDTQLTRLM

SEQ ID NO: 1395948 - protein, 9 aa, Homo Sapiens
SAECSVLPR

SEQ ID NO: 1395949 - protein, 9 aa, Homo Sapiens
RFWRWSPCS

SEQ ID NO: 1395950 - protein, 9 aa, Homo Sapiens
DRTESLNRY

SEQ ID NO: 1395951 - protein, 9 aa, Homo Sapiens
HPCPLPPQV

SEQ ID NO: 1395952 - protein, 9 aa, Homo Sapiens
SSWNRLREG

SEQ ID NO: 1395953 - protein, 9 aa, Homo Sapiens
PPTSCPPLL

SEQ ID NO: 1395954 - protein, 9 aa, Homo Sapiens
HIPYVMKTG

SEQ ID NO: 1395955 - protein, 9 aa, Homo Sapiens
FQNWRMKMK

SEQ ID NO: 1395956 - protein, 9 aa, Homo Sapiens
PVIEYSVGS

SEQ ID NO: 1395957 - protein, 9 aa, Homo Sapiens
TASDHGCPS

SEQ ID NO: 1395958 - protein, 9 aa, Homo Sapiens
ARATSGTAP

SEQ ID NO: 1395959 - protein, 9 aa, Homo Sapiens
CNPEWLVCL

SEQ ID NO: 1395960 - protein, 9 aa, Homo Sapiens
LPLRGFLLH

SEQ ID NO: 1395961 - protein, 9 aa, Homo Sapiens
PTTTTSSPR

SEQ ID NO: 1395962 - protein, 9 aa, Homo Sapiens
VLPAPRMRG

SEQ ID NO: 1395963 - protein, 9 aa, Homo Sapiens
PQRPKPSSS

SEQ ID NO: 1395964 - protein, 9 aa, Homo Sapiens
VGLQILHPY

SEQ ID NO: 1395965 - protein, 9 aa, Homo Sapiens
LVFGLLLLS

SEQ ID NO: 1395966 - protein, 9 aa, Homo Sapiens
QVKIWFQNW

SEQ ID NO: 1395967 - protein, 9 aa, Homo Sapiens
IETSAKSKT

SEQ ID NO: 1395968 - protein, 9 aa, Homo Sapiens
DDMHTDVIH

SEQ ID NO: 1395969 - protein, 9 aa, Homo Sapiens
RLWRPTAIR

SEQ ID NO: 1395970 - protein, 9 aa, Homo Sapiens
VYIFTRPTY

SEQ ID NO: 1395971 - protein, 9 aa, Homo Sapiens
AQVEQLCQA

SEQ ID NO: 1395972 - protein, 9 aa, Homo Sapiens
YRKMYGDVA

SEQ ID NO: 1395973 - protein, 9 aa, Homo Sapiens
QALFQVATT

SEQ ID NO: 1395974 - protein, 9 aa, Homo Sapiens
SNLGGRGRQ

SEQ ID NO: 1395975 - protein, 9 aa, Homo Sapiens
WLEPCTPVP

SEQ ID NO: 1395976 - protein, 9 aa, Homo Sapiens
AVGFVLPLV

SEQ ID NO: 1395977 - protein, 9 aa, Homo Sapiens
VDNGAAQMG

SEQ ID NO: 1395978 - protein, 9 aa, Homo Sapiens
NIPGIRGAL

SEQ ID NO: 1395979 - protein, 9 aa, Homo Sapiens
ITECVRTAL

SEQ ID NO: 1395980 - protein, 9 aa, Homo Sapiens
CTSDVGWGD

SEQ ID NO: 1395981 - protein, 9 aa, Homo Sapiens
RTWWRTRAC

SEQ ID NO: 1395982 - protein, 9 aa, Homo Sapiens
KIPEGFQDK

SEQ ID NO: 1395983 - protein, 9 aa, Homo Sapiens
LPGPTVPDL

SEQ ID NO: 1395984 - protein, 9 aa, Homo Sapiens
ASCGPTSGS

SEQ ID NO: 1395985 - protein, 9 aa, Homo Sapiens
VTVHLQTLL

SEQ ID NO: 1395986 - protein, 9 aa, Homo Sapiens
YQEAEDYPF

SEQ ID NO: 1395987 - protein, 9 aa, Homo Sapiens
MTCCTVFWA

SEQ ID NO: 1395988 - protein, 9 aa, Homo Sapiens
SKTVDYHRL

SEQ ID NO: 1395989 - protein, 9 aa, Homo Sapiens
SGAPGLAMP

SEQ ID NO: 1395990 - protein, 9 aa, Homo Sapiens
QVATTEMEP

SEQ ID NO: 1395991 - protein, 9 aa, Homo Sapiens
IQVTATNPS

SEQ ID NO: 1395992 - protein, 9 aa, Homo Sapiens
RGEEAALQI

SEQ ID NO: 1395993 - protein, 9 aa, Homo Sapiens
KDKKETKFQ

SEQ ID NO: 1395994 - protein, 9 aa, Homo Sapiens
CDFGTTCDI

SEQ ID NO: 1395995 - protein, 9 aa, Homo Sapiens
RFCNTVHDV

SEQ ID NO: 1395996 - protein, 9 aa, Homo Sapiens
VLKNPPENP

SEQ ID NO: 1395997 - protein, 9 aa, Homo Sapiens
AGGGGPATF

SEQ ID NO: 1395998 - protein, 9 aa, Homo Sapiens
RRRRRRRRE

SEQ ID NO: 1395999 - protein, 9 aa, Homo Sapiens
SWPTRRSTM

SEQ ID NO: 1396000 - protein, 9 aa, Homo Sapiens
SARRSRRAQ

SEQ ID NO: 1396001 - protein, 9 aa, Homo Sapiens
FLVQRTVAH

SEQ ID NO: 1396002 - protein, 9 aa, Homo Sapiens
ELRQGLTFP

SEQ ID NO: 1396003 - protein, 9 aa, Homo Sapiens
ASFNYLRLV

SEQ ID NO: 1396004 - protein, 9 aa, Homo Sapiens
TRIACKVWA

SEQ ID NO: 1396005 - protein, 9 aa, Homo Sapiens
GHGGTHAFG

SEQ ID NO: 1396006 - protein, 9 aa, Homo Sapiens
FFGYTFVAF

SEQ ID NO: 1396007 - protein, 9 aa, Homo Sapiens
ANLEHSLLV

SEQ ID NO: 1396008 - protein, 9 aa, Homo Sapiens
AHITCRLYS

SEQ ID NO: 1396009 - protein, 9 aa, Homo Sapiens
EQSLWKLMP

SEQ ID NO: 1396010 - protein, 9 aa, Homo Sapiens
QASYTPSPA

SEQ ID NO: 1396011 - protein, 9 aa, Homo Sapiens
CLFCGNIFL

SEQ ID NO: 1396012 - protein, 9 aa, Homo Sapiens
IAVQAGDGH

SEQ ID NO: 1396013 - protein, 9 aa, Homo Sapiens
ASGPTPVPT

SEQ ID NO: 1396014 - protein, 9 aa, Homo Sapiens
YYFLEIAST

SEQ ID NO: 1396015 - protein, 9 aa, Homo Sapiens
HIMTCCTVF

SEQ ID NO: 1396016 - protein, 9 aa, Homo Sapiens
VVCRSRSLA

SEQ ID NO: 1396017 - protein, 9 aa, Homo Sapiens
SGRGCLLPV

SEQ ID NO: 1396018 - protein, 9 aa, Homo Sapiens
RSPALRARG

SEQ ID NO: 1396019 - protein, 9 aa, Homo Sapiens
ANHALPVYI

SEQ ID NO: 1396020 - protein, 9 aa, Homo Sapiens
SPATTRRAS

SEQ ID NO: 1396021 - protein, 9 aa, Homo Sapiens
IFVQNSGWL

SEQ ID NO: 1396022 - protein, 9 aa, Homo Sapiens
PVAESPAGR

SEQ ID NO: 1396023 - protein, 9 aa, Homo Sapiens
VLGVMVARC

SEQ ID NO: 1396024 - protein, 9 aa, Homo Sapiens
MYEHLWTSL

SEQ ID NO: 1396025 - protein, 9 aa, Homo Sapiens
IPCGPARSA

SEQ ID NO: 1396026 - protein, 9 aa, Homo Sapiens
VGALMPAAT

SEQ ID NO: 1396027 - protein, 9 aa, Homo Sapiens
ITMGTARPS

SEQ ID NO: 1396028 - protein, 9 aa, Homo Sapiens
EELNCCRDV

SEQ ID NO: 1396029 - protein, 9 aa, Homo Sapiens
PRHLVQLLR

SEQ ID NO: 1396030 - protein, 9 aa, Homo Sapiens
YFYTRFAAY

SEQ ID NO: 1396031 - protein, 9 aa, Homo Sapiens
LLPVWPALL

SEQ ID NO: 1396032 - protein, 9 aa, Homo Sapiens
AEEVILALH

SEQ ID NO: 1396033 - protein, 9 aa, Homo Sapiens
TATNPSMRA

SEQ ID NO: 1396034 - protein, 9 aa, Homo Sapiens
FLPSMPGPK

SEQ ID NO: 1396035 - protein, 9 aa, Homo Sapiens
DKENPGAIE

SEQ ID NO: 1396036 - protein, 9 aa, Homo Sapiens
TTWASLATL

SEQ ID NO: 1396037 - protein, 9 aa, Homo Sapiens
PSALDYKIF

SEQ ID NO: 1396038 - protein, 9 aa, Homo Sapiens
DSCTVNNHA

SEQ ID NO: 1396039 - protein, 9 aa, Homo Sapiens
ISLILGAWI

SEQ ID NO: 1396040 - protein, 9 aa, Homo Sapiens
WEVMPRTLE

SEQ ID NO: 1396041 - protein, 9 aa, Homo Sapiens
CLMVIVIVL

SEQ ID NO: 1396042 - protein, 9 aa, Homo Sapiens
PTPASGGLT

SEQ ID NO: 1396043 - protein, 9 aa, Homo Sapiens
IPAKKGLPV

SEQ ID NO: 1396044 - protein, 9 aa, Homo Sapiens
EKYMQAVWQ

SEQ ID NO: 1396045 - protein, 9 aa, Homo Sapiens
EMPVPACWI

SEQ ID NO: 1396046 - protein, 9 aa, Homo Sapiens
LLCEASTIV

SEQ ID NO: 1396047 - protein, 9 aa, Homo Sapiens
ALVGGEITD

SEQ ID NO: 1396048 - protein, 9 aa, Homo Sapiens
AQSAEEPWT

SEQ ID NO: 1396049 - protein, 9 aa, Homo Sapiens
NHALPVYIF

SEQ ID NO: 1396050 - protein, 9 aa, Homo Sapiens
LGMPSMPSS

SEQ ID NO: 1396051 - protein, 9 aa, Homo Sapiens
YPDSQLPIP

SEQ ID NO: 1396052 - protein, 9 aa, Homo Sapiens
KAEQRFVQG

SEQ ID NO: 1396053 - protein, 9 aa, Homo Sapiens
HFTGPKAPC

SEQ ID NO: 1396054 - protein, 9 aa, Homo Sapiens
LPVYIFTRP

SEQ ID NO: 1396055 - protein, 9 aa, Homo Sapiens
PKKRSKKVS

SEQ ID NO: 1396056 - protein, 9 aa, Homo Sapiens
ARCKREHST

SEQ ID NO: 1396057 - protein, 9 aa, Homo Sapiens
ISNYLVDKH

SEQ ID NO: 1396058 - protein, 9 aa, Homo Sapiens
RQDYASTST

SEQ ID NO: 1396059 - protein, 9 aa, Homo Sapiens
KRDPQQGQF

SEQ ID NO: 1396060 - protein, 9 aa, Homo Sapiens
MKTGSDMFV

SEQ ID NO: 1396061 - protein, 9 aa, Homo Sapiens
PSTAATTAA

SEQ ID NO: 1396062 - protein, 9 aa, Homo Sapiens
TISSCLGHG

SEQ ID NO: 1396063 - protein, 9 aa, Homo Sapiens
PPKICCPHS

SEQ ID NO: 1396064 - protein, 9 aa, Homo Sapiens
PEWLVCLYH

SEQ ID NO: 1396065 - protein, 9 aa, Homo Sapiens
GPSCSRGSQ

SEQ ID NO: 1396066 - protein, 9 aa, Homo Sapiens
IEFYILTAM

SEQ ID NO: 1396067 - protein, 9 aa, Homo Sapiens
AARPSATNP

SEQ ID NO: 1396068 - protein, 9 aa, Homo Sapiens
SQLFILCLC

SEQ ID NO: 1396069 - protein, 9 aa, Homo Sapiens
KFHFEELLV

SEQ ID NO: 1396070 - protein, 9 aa, Homo Sapiens
GSLASGAPG

SEQ ID NO: 1396071 - protein, 9 aa, Homo Sapiens
NWLCTSWVP

SEQ ID NO: 1396072 - protein, 9 aa, Homo Sapiens
FLEIASTYL

SEQ ID NO: 1396073 - protein, 9 aa, Homo Sapiens
EVHEWNDGR

SEQ ID NO: 1396074 - protein, 9 aa, Homo Sapiens
GSWMGARGP

SEQ ID NO: 1396075 - protein, 9 aa, Homo Sapiens
GADINLIDV

SEQ ID NO: 1396076 - protein, 9 aa, Homo Sapiens
QLQLCQKEQ

SEQ ID NO: 1396077 - protein, 9 aa, Homo Sapiens
PLCGYPGPA

SEQ ID NO: 1396078 - protein, 9 aa, Homo Sapiens
EKTPTADPP

SEQ ID NO: 1396079 - protein, 9 aa, Homo Sapiens
QRFVQGHFT

SEQ ID NO: 1396080 - protein, 9 aa, Homo Sapiens
SRLPGPPTL

SEQ ID NO: 1396081 - protein, 9 aa, Homo Sapiens
EAEVPADDE

SEQ ID NO: 1396082 - protein, 9 aa, Homo Sapiens
HYYQLQPMV

SEQ ID NO: 1396083 - protein, 9 aa, Homo Sapiens
KPTPNDKGK

SEQ ID NO: 1396084 - protein, 9 aa, Homo Sapiens
YHFCVGSLI

SEQ ID NO: 1396085 - protein, 9 aa, Homo Sapiens
LRKALKFKK

SEQ ID NO: 1396086 - protein, 9 aa, Homo Sapiens
SSAPRHHPR

SEQ ID NO: 1396087 - protein, 9 aa, Homo Sapiens
PPAWDERLP

SEQ ID NO: 1396088 - protein, 9 aa, Homo Sapiens
STGCSLGSR

SEQ ID NO: 1396089 - protein, 9 aa, Homo Sapiens
QELDEVVAE

SEQ ID NO: 1396090 - protein, 9 aa, Homo Sapiens
RSPRMRHRM

SEQ ID NO: 1396091 - protein, 9 aa, Homo Sapiens
FRDLTQLAV

SEQ ID NO: 1396092 - protein, 9 aa, Homo Sapiens
LEFKRISAT

SEQ ID NO: 1396093 - protein, 9 aa, Homo Sapiens
RSGSSFSWR

SEQ ID NO: 1396094 - protein, 9 aa, Homo Sapiens
DMMLENYRN

SEQ ID NO: 1396095 - protein, 9 aa, Homo Sapiens
GRMFCSGNA

SEQ ID NO: 1396096 - protein, 9 aa, Homo Sapiens
HPRSRPGPQ

SEQ ID NO: 1396097 - protein, 9 aa, Homo Sapiens
FFIFMGVIE

SEQ ID NO: 1396098 - protein, 9 aa, Homo Sapiens
PVCNGGMTP

SEQ ID NO: 1396099 - protein, 9 aa, Homo Sapiens
TLKPPAPPQ

SEQ ID NO: 1396100 - protein, 9 aa, Homo Sapiens
IYLAHNAKD

SEQ ID NO: 1396101 - protein, 9 aa, Homo Sapiens
SFRRTHVYI

SEQ ID NO: 1396102 - protein, 9 aa, Homo Sapiens
YQMTPQSPS

SEQ ID NO: 1396103 - protein, 9 aa, Homo Sapiens
DASVGWLQW

SEQ ID NO: 1396104 - protein, 9 aa, Homo Sapiens
HRVLVAHYV

SEQ ID NO: 1396105 - protein, 9 aa, Homo Sapiens
HGSPGPRMG

SEQ ID NO: 1396106 - protein, 9 aa, Homo Sapiens
ASPTTPSQH

SEQ ID NO: 1396107 - protein, 9 aa, Homo Sapiens
GTNFWGVPR

SEQ ID NO: 1396108 - protein, 9 aa, Homo Sapiens
IASTYLIFC

SEQ ID NO: 1396109 - protein, 9 aa, Homo Sapiens
ALCHLASGR

SEQ ID NO: 1396110 - protein, 9 aa, Homo Sapiens
SCSRGSQRA

SEQ ID NO: 1396111 - protein, 9 aa, Homo Sapiens
NKPPLRTTM

SEQ ID NO: 1396112 - protein, 9 aa, Homo Sapiens
TYDVLHSEL

SEQ ID NO: 1396113 - protein, 9 aa, Homo Sapiens
DHTVRIWDL

SEQ ID NO: 1396114 - protein, 9 aa, Homo Sapiens
LRTTMKRPF

SEQ ID NO: 1396115 - protein, 9 aa, Homo Sapiens
STPARSPTS

SEQ ID NO: 1396116 - protein, 9 aa, Homo Sapiens
AFTEAWGAR

SEQ ID NO: 1396117 - protein, 9 aa, Homo Sapiens
QVRQDLSSP

SEQ ID NO: 1396118 - protein, 9 aa, Homo Sapiens
PKAPCPGTL

SEQ ID NO: 1396119 - protein, 9 aa, Homo Sapiens
APNVNMESS

SEQ ID NO: 1396120 - protein, 9 aa, Homo Sapiens
TILLAYGES

SEQ ID NO: 1396121 - protein, 9 aa, Homo Sapiens
NARTAVIRE

SEQ ID NO: 1396122 - protein, 9 aa, Homo Sapiens
LAPNVNMES

SEQ ID NO: 1396123 - protein, 9 aa, Homo Sapiens
WKFSGVTSV

SEQ ID NO: 1396124 - protein, 9 aa, Homo Sapiens
KQPQGPSCS

SEQ ID NO: 1396125 - protein, 9 aa, Homo Sapiens
GDGHGRLVI

SEQ ID NO: 1396126 - protein, 9 aa, Homo Sapiens
KENPGAIEA

SEQ ID NO: 1396127 - protein, 9 aa, Homo Sapiens
REHYWEEKE

SEQ ID NO: 1396128 - protein, 9 aa, Homo Sapiens
LEKPSALDY

SEQ ID NO: 1396129 - protein, 9 aa, Homo Sapiens
TLEDLKIYL

SEQ ID NO: 1396130 - protein, 9 aa, Homo Sapiens
PSASLHPAS

SEQ ID NO: 1396131 - protein, 9 aa, Homo Sapiens
GGGGPATFH

SEQ ID NO: 1396132 - protein, 9 aa, Homo Sapiens
PPIGPSCVP

SEQ ID NO: 1396133 - protein, 9 aa, Homo Sapiens
CMTAHSGTT

SEQ ID NO: 1396134 - protein, 9 aa, Homo Sapiens
SASCGPTSG

SEQ ID NO: 1396135 - protein, 9 aa, Homo Sapiens
FPHCSETAR

SEQ ID NO: 1396136 - protein, 9 aa, Homo Sapiens
RRKKPSKRR

SEQ ID NO: 1396137 - protein, 9 aa, Homo Sapiens
TEGPPRTRE

SEQ ID NO: 1396138 - protein, 9 aa, Homo Sapiens
RSWAWTCPR

SEQ ID NO: 1396139 - protein, 9 aa, Homo Sapiens
DRQDWQNLV

SEQ ID NO: 1396140 - protein, 9 aa, Homo Sapiens
FCTGKVCYD

SEQ ID NO: 1396141 - protein, 9 aa, Homo Sapiens
NYVACGGLY

SEQ ID NO: 1396142 - protein, 9 aa, Homo Sapiens
KRDGKIIVG

SEQ ID NO: 1396143 - protein, 9 aa, Homo Sapiens
GTSYPHSAW

SEQ ID NO: 1396144 - protein, 9 aa, Homo Sapiens
NWRRGSTAR

SEQ ID NO: 1396145 - protein, 9 aa, Homo Sapiens
DKPFRCEIY

SEQ ID NO: 1396146 - protein, 9 aa, Homo Sapiens
LDPQPFLRV

SEQ ID NO: 1396147 - protein, 9 aa, Homo Sapiens
SRVRVGVQT

SEQ ID NO: 1396148 - protein, 9 aa, Homo Sapiens
QDGSLDRNL

SEQ ID NO: 1396149 - protein, 9 aa, Homo Sapiens
LLQVRQDLS

SEQ ID NO: 1396150 - protein, 9 aa, Homo Sapiens
DSQLPIPED

SEQ ID NO: 1396151 - protein, 9 aa, Homo Sapiens
FNPDHIRVQ

SEQ ID NO: 1396152 - protein, 9 aa, Homo Sapiens
SKRRWSRSP

SEQ ID NO: 1396153 - protein, 9 aa, Homo Sapiens
SWLPEFIVQ

SEQ ID NO: 1396154 - protein, 9 aa, Homo Sapiens
SRQTLQNSQ

SEQ ID NO: 1396155 - protein, 9 aa, Homo Sapiens
RVEGLLYGG

SEQ ID NO: 1396156 - protein, 9 aa, Homo Sapiens
AERQREHYW

SEQ ID NO: 1396157 - protein, 9 aa, Homo Sapiens
LSPIECTEL

SEQ ID NO: 1396158 - protein, 9 aa, Homo Sapiens
SCTARAPLP

SEQ ID NO: 1396159 - protein, 9 aa, Homo Sapiens
VRLLLGVCG

SEQ ID NO: 1396160 - protein, 9 aa, Homo Sapiens
GAKAREEGY

SEQ ID NO: 1396161 - protein, 9 aa, Homo Sapiens
GGSVPWRLS

SEQ ID NO: 1396162 - protein, 9 aa, Homo Sapiens
AIPANSEDG

SEQ ID NO: 1396163 - protein, 9 aa, Homo Sapiens
PLPKRQELE

SEQ ID NO: 1396164 - protein, 9 aa, Homo Sapiens
EEAAKLYDI

SEQ ID NO: 1396165 - protein, 9 aa, Homo Sapiens
PTATAASAR

SEQ ID NO: 1396166 - protein, 9 aa, Homo Sapiens
ILCLCTCTW

SEQ ID NO: 1396167 - protein, 9 aa, Homo Sapiens
GGPAGWARQ

SEQ ID NO: 1396168 - protein, 9 aa, Homo Sapiens
LARSLVPQV

SEQ ID NO: 1396169 - protein, 9 aa, Homo Sapiens
NFSALLCYD

SEQ ID NO: 1396170 - protein, 9 aa, Homo Sapiens
GASLWGPQT

SEQ ID NO: 1396171 - protein, 9 aa, Homo Sapiens
GPSQLPHTR

SEQ ID NO: 1396172 - protein, 9 aa, Homo Sapiens
FVLYYGQEV

SEQ ID NO: 1396173 - protein, 9 aa, Homo Sapiens
SPVCNGGMT

SEQ ID NO: 1396174 - protein, 9 aa, Homo Sapiens
KTGVCHLCL

SEQ ID NO: 1396175 - protein, 9 aa, Homo Sapiens
QVLFMNIQE

SEQ ID NO: 1396176 - protein, 9 aa, Homo Sapiens
EEDTDPRHL

SEQ ID NO: 1396177 - protein, 9 aa, Homo Sapiens
MEFSSPILN

SEQ ID NO: 1396178 - protein, 9 aa, Homo Sapiens
PRKKPPRRK

SEQ ID NO: 1396179 - protein, 9 aa, Homo Sapiens
TRACTPASG

SEQ ID NO: 1396180 - protein, 9 aa, Homo Sapiens
RMEDATERE

SEQ ID NO: 1396181 - protein, 9 aa, Homo Sapiens
ATIAPVECP

SEQ ID NO: 1396182 - protein, 9 aa, Homo Sapiens
ARGMGGQPR

SEQ ID NO: 1396183 - protein, 9 aa, Homo Sapiens
HHSQPVQEA

SEQ ID NO: 1396184 - protein, 9 aa, Homo Sapiens
KIFETLRID

SEQ ID NO: 1396185 - protein, 9 aa, Homo Sapiens
VRPPVTTSR

SEQ ID NO: 1396186 - protein, 9 aa, Homo Sapiens
QSQDPRLPA

SEQ ID NO: 1396187 - protein, 9 aa, Homo Sapiens
LSPLYRSPH

SEQ ID NO: 1396188 - protein, 9 aa, Homo Sapiens
YEMPVPACW

SEQ ID NO: 1396189 - protein, 9 aa, Homo Sapiens
WRLFLIIQT

SEQ ID NO: 1396190 - protein, 9 aa, Homo Sapiens
AQRTLYRDM

SEQ ID NO: 1396191 - protein, 9 aa, Homo Sapiens
KIDSLIGKG

SEQ ID NO: 1396192 - protein, 9 aa, Homo Sapiens
PSSLPQDVC

SEQ ID NO: 1396193 - protein, 9 aa, Homo Sapiens
GCQMCAACG

SEQ ID NO: 1396194 - protein, 9 aa, Homo Sapiens
QNINECEHR

SEQ ID NO: 1396195 - protein, 9 aa, Homo Sapiens
VAESPAGRA

SEQ ID NO: 1396196 - protein, 9 aa, Homo Sapiens
QTAATLQPG

SEQ ID NO: 1396197 - protein, 9 aa, Homo Sapiens
VNMQGTRNV

SEQ ID NO: 1396198 - protein, 9 aa, Homo Sapiens
RDSWPTRRS

SEQ ID NO: 1396199 - protein, 9 aa, Homo Sapiens
CHFGSPSGG

SEQ ID NO: 1396200 - protein, 9 aa, Homo Sapiens
CRTEMQLWR

SEQ ID NO: 1396201 - protein, 9 aa, Homo Sapiens
LICDIDRYR

SEQ ID NO: 1396202 - protein, 9 aa, Homo Sapiens
RVILPDDVC

SEQ ID NO: 1396203 - protein, 9 aa, Homo Sapiens
PTSSPTARA

SEQ ID NO: 1396204 - protein, 9 aa, Homo Sapiens
SVASIKVSV

SEQ ID NO: 1396205 - protein, 9 aa, Homo Sapiens
TVLGPSVTC

SEQ ID NO: 1396206 - protein, 9 aa, Homo Sapiens
QLFSQYERI

SEQ ID NO: 1396207 - protein, 9 aa, Homo Sapiens
TVFPLCPWL

SEQ ID NO: 1396208 - protein, 9 aa, Homo Sapiens
TFNGESSWL

SEQ ID NO: 1396209 - protein, 9 aa, Homo Sapiens
LPKRQELEK

SEQ ID NO: 1396210 - protein, 9 aa, Homo Sapiens
IPIRLLVPT

SEQ ID NO: 1396211 - protein, 9 aa, Homo Sapiens
TLGQRPRQP

SEQ ID NO: 1396212 - protein, 9 aa, Homo Sapiens
DGSLDRNLG

SEQ ID NO: 1396213 - protein, 9 aa, Homo Sapiens
LCRQLALGM

SEQ ID NO: 1396214 - protein, 9 aa, Homo Sapiens
EGLDMRPFL

SEQ ID NO: 1396215 - protein, 9 aa, Homo Sapiens
RKAHPCPLP

SEQ ID NO: 1396216 - protein, 9 aa, Homo Sapiens
LGPVLLSRW

SEQ ID NO: 1396217 - protein, 9 aa, Homo Sapiens
HLASGRGCL

SEQ ID NO: 1396218 - protein, 9 aa, Homo Sapiens
SFKTVIKKR

SEQ ID NO: 1396219 - protein, 9 aa, Homo Sapiens
VKIWFQNWR

SEQ ID NO: 1396220 - protein, 9 aa, Homo Sapiens
ARTMLCFWT

SEQ ID NO: 1396221 - protein, 9 aa, Homo Sapiens
LSLFYTYKG

SEQ ID NO: 1396222 - protein, 9 aa, Homo Sapiens
HWNQRGSHW

SEQ ID NO: 1396223 - protein, 9 aa, Homo Sapiens
QLARQLMHL

SEQ ID NO: 1396224 - protein, 9 aa, Homo Sapiens
QLRGSSPVG

SEQ ID NO: 1396225 - protein, 9 aa, Homo Sapiens
LVDNDLDSF

SEQ ID NO: 1396226 - protein, 9 aa, Homo Sapiens
LLQQRHSVL

SEQ ID NO: 1396227 - protein, 9 aa, Homo Sapiens
DKAFNHSAT

SEQ ID NO: 1396228 - protein, 9 aa, Homo Sapiens
VGFVLPLVV

SEQ ID NO: 1396229 - protein, 9 aa, Homo Sapiens
ELSQLFILC

SEQ ID NO: 1396230 - protein, 9 aa, Homo Sapiens
PGNWIAHFR

SEQ ID NO: 1396231 - protein, 9 aa, Homo Sapiens
RHLEYLKSP

SEQ ID NO: 1396232 - protein, 9 aa, Homo Sapiens
RHVGGKAPG

SEQ ID NO: 1396233 - protein, 9 aa, Homo Sapiens
TTSCLKFLS

SEQ ID NO: 1396234 - protein, 9 aa, Homo Sapiens
CFLELRQGL

SEQ ID NO: 1396235 - protein, 9 aa, Homo Sapiens
KASKAAWIR

SEQ ID NO: 1396236 - protein, 9 aa, Homo Sapiens
MAKSGGEEA

SEQ ID NO: 1396237 - protein, 9 aa, Homo Sapiens
SHPHGSPGP

SEQ ID NO: 1396238 - protein, 9 aa, Homo Sapiens
QMVHFTVRE

SEQ ID NO: 1396239 - protein, 9 aa, Homo Sapiens
AETLALVGG

SEQ ID NO: 1396240 - protein, 9 aa, Homo Sapiens
QPVTKTITT

SEQ ID NO: 1396241 - protein, 9 aa, Homo Sapiens
GANSLSSAE

SEQ ID NO: 1396242 - protein, 9 aa, Homo Sapiens
KGSVALRDN

SEQ ID NO: 1396243 - protein, 9 aa, Homo Sapiens
ALQIPLTTR

SEQ ID NO: 1396244 - protein, 9 aa, Homo Sapiens
TVNPFLPSM

SEQ ID NO: 1396245 - protein, 9 aa, Homo Sapiens
QQRHSVLRG

SEQ ID NO: 1396246 - protein, 9 aa, Homo Sapiens
QFFSQTYMH

SEQ ID NO: 1396247 - protein, 9 aa, Homo Sapiens
GLITIGASP

SEQ ID NO: 1396248 - protein, 9 aa, Homo Sapiens
SPTSAPTAA

SEQ ID NO: 1396249 - protein, 9 aa, Homo Sapiens
GKKRGKRVA

SEQ ID NO: 1396250 - protein, 9 aa, Homo Sapiens
RGPTPPRSS

SEQ ID NO: 1396251 - protein, 9 aa, Homo Sapiens
KPRRRRGSP

SEQ ID NO: 1396252 - protein, 9 aa, Homo Sapiens
CKWTEPYCI

SEQ ID NO: 1396253 - protein, 9 aa, Homo Sapiens
KKPPRRKKP

SEQ ID NO: 1396254 - protein, 9 aa, Homo Sapiens
LKNPPENPE

SEQ ID NO: 1396255 - protein, 9 aa, Homo Sapiens
SPLMSEFRK

SEQ ID NO: 1396256 - protein, 9 aa, Homo Sapiens
CSCGVTGLK

SEQ ID NO: 1396257 - protein, 9 aa, Homo Sapiens
ASPPAWDER

SEQ ID NO: 1396258 - protein, 9 aa, Homo Sapiens
IIVHQRTHT

SEQ ID NO: 1396259 - protein, 9 aa, Homo Sapiens
EKGKDSATD

SEQ ID NO: 1396260 - protein, 9 aa, Homo Sapiens
PCPGTLSFP

SEQ ID NO: 1396261 - protein, 9 aa, Homo Sapiens
KRDQCFQMM

SEQ ID NO: 1396262 - protein, 9 aa, Homo Sapiens
SLHPASGRA

SEQ ID NO: 1396263 - protein, 9 aa, Homo Sapiens
KWTEPYCII

SEQ ID NO: 1396264 - protein, 9 aa, Homo Sapiens
TPVAESPAG

SEQ ID NO: 1396265 - protein, 9 aa, Homo Sapiens
TVVTRVWHP

SEQ ID NO: 1396266 - protein, 9 aa, Homo Sapiens
SGSENHKVY

SEQ ID NO: 1396267 - protein, 9 aa, Homo Sapiens
QSQGPRSCS

SEQ ID NO: 1396268 - protein, 9 aa, Homo Sapiens
PTGSRRNGS

SEQ ID NO: 1396269 - protein, 9 aa, Homo Sapiens
LKDENAVLI

SEQ ID NO: 1396270 - protein, 9 aa, Homo Sapiens
CRWPSLESS

SEQ ID NO: 1396271 - protein, 9 aa, Homo Sapiens
TPPKITSPL

SEQ ID NO: 1396272 - protein, 9 aa, Homo Sapiens
LKENAALPT

SEQ ID NO: 1396273 - protein, 9 aa, Homo Sapiens
DMLGFFVLY

SEQ ID NO: 1396274 - protein, 9 aa, Homo Sapiens
SVCGYSGSG

SEQ ID NO: 1396275 - protein, 9 aa, Homo Sapiens
QTPYCISIA

SEQ ID NO: 1396276 - protein, 9 aa, Homo Sapiens
CTKRKGECN

SEQ ID NO: 1396277 - protein, 9 aa, Homo Sapiens
QHPGDGDAH

SEQ ID NO: 1396278 - protein, 9 aa, Homo Sapiens
VCGHLKPSG

SEQ ID NO: 1396279 - protein, 9 aa, Homo Sapiens
WISSQTRYA

SEQ ID NO: 1396280 - protein, 9 aa, Homo Sapiens
LGQRPRQPS

SEQ ID NO: 1396281 - protein, 9 aa, Homo Sapiens
IIQTTGYQS

SEQ ID NO: 1396282 - protein, 9 aa, Homo Sapiens
TALQNNFQE

SEQ ID NO: 1396283 - protein, 9 aa, Homo Sapiens
SWAWTCPRK

SEQ ID NO: 1396284 - protein, 9 aa, Homo Sapiens
LQLQGLVAG

SEQ ID NO: 1396285 - protein, 9 aa, Homo Sapiens
SDNGGHPEP

SEQ ID NO: 1396286 - protein, 9 aa, Homo Sapiens
IDGHRGQCP

SEQ ID NO: 1396287 - protein, 9 aa, Homo Sapiens
SASPAVAVP

SEQ ID NO: 1396288 - protein, 9 aa, Homo Sapiens
IAWQSITMG

SEQ ID NO: 1396289 - protein, 9 aa, Homo Sapiens
LLENGTRVQ

SEQ ID NO: 1396290 - protein, 9 aa, Homo Sapiens
YIPSSLAQR

SEQ ID NO: 1396291 - protein, 9 aa, Homo Sapiens
IQDTKLPKA

SEQ ID NO: 1396292 - protein, 9 aa, Homo Sapiens
ELDHTRADL

SEQ ID NO: 1396293 - protein, 9 aa, Homo Sapiens
GCKGFFRCS

SEQ ID NO: 1396294 - protein, 9 aa, Homo Sapiens
DAVDLRKAL

SEQ ID NO: 1396295 - protein, 9 aa, Homo Sapiens
GRVAVVPLG

SEQ ID NO: 1396296 - protein, 9 aa, Homo Sapiens
TPPPAATSA

SEQ ID NO: 1396297 - protein, 9 aa, Homo Sapiens
IGNHYMEMV

SEQ ID NO: 1396298 - protein, 9 aa, Homo Sapiens
RQREHYWEE

SEQ ID NO: 1396299 - protein, 9 aa, Homo Sapiens
CKTCGTMFT

SEQ ID NO: 1396300 - protein, 9 aa, Homo Sapiens
QSRPRKSHR

SEQ ID NO: 1396301 - protein, 9 aa, Homo Sapiens
DWQNLVTFG

SEQ ID NO: 1396302 - protein, 9 aa, Homo Sapiens
EQLCQAIEE

SEQ ID NO: 1396303 - protein, 9 aa, Homo Sapiens
TTPSQHFTG

SEQ ID NO: 1396304 - protein, 9 aa, Homo Sapiens
LFSGEATHC

SEQ ID NO: 1396305 - protein, 9 aa, Homo Sapiens
AQIQRPIQV

SEQ ID NO: 1396306 - protein, 9 aa, Homo Sapiens
VDIDPPKIC

SEQ ID NO: 1396307 - protein, 9 aa, Homo Sapiens
ALLLYYLVT

SEQ ID NO: 1396308 - protein, 9 aa, Homo Sapiens
STTRRDSWP

SEQ ID NO: 1396309 - protein, 9 aa, Homo Sapiens
PLSRARSVE

SEQ ID NO: 1396310 - protein, 9 aa, Homo Sapiens
DGCKGFFRC

SEQ ID NO: 1396311 - protein, 9 aa, Homo Sapiens
VDIPIRLLV

SEQ ID NO: 1396312 - protein, 9 aa, Homo Sapiens
STRGRSVRP

SEQ ID NO: 1396313 - protein, 9 aa, Homo Sapiens
VLFLLLWRL

SEQ ID NO: 1396314 - protein, 9 aa, Homo Sapiens
SGGAEGGGG

SEQ ID NO: 1396315 - protein, 9 aa, Homo Sapiens
PPMGVVQNE

SEQ ID NO: 1396316 - protein, 9 aa, Homo Sapiens
LPSMPGPKK

SEQ ID NO: 1396317 - protein, 9 aa, Homo Sapiens
RARLQSQRP

SEQ ID NO: 1396318 - protein, 9 aa, Homo Sapiens
STLKPPAPP

SEQ ID NO: 1396319 - protein, 9 aa, Homo Sapiens
CGGIIMALG

SEQ ID NO: 1396320 - protein, 9 aa, Homo Sapiens
ENPEQAVGA

SEQ ID NO: 1396321 - protein, 9 aa, Homo Sapiens
TLEPQNQNF

SEQ ID NO: 1396322 - protein, 9 aa, Homo Sapiens
TVTVLSQKL

SEQ ID NO: 1396323 - protein, 9 aa, Homo Sapiens
SSVNFLMVF

SEQ ID NO: 1396324 - protein, 9 aa, Homo Sapiens
LCMAVTRQF

SEQ ID NO: 1396325 - protein, 9 aa, Homo Sapiens
LQFFSQTYM

SEQ ID NO: 1396326 - protein, 9 aa, Homo Sapiens
PWTLRKQPQ

SEQ ID NO: 1396327 - protein, 9 aa, Homo Sapiens
ENIGVKTVM

SEQ ID NO: 1396328 - protein, 9 aa, Homo Sapiens
RLLEVIASL

SEQ ID NO: 1396329 - protein, 9 aa, Homo Sapiens
GAAQMGTVV

SEQ ID NO: 1396330 - protein, 9 aa, Homo Sapiens
FLWFFSKRI

SEQ ID NO: 1396331 - protein, 9 aa, Homo Sapiens
CYDLTRERK

SEQ ID NO: 1396332 - protein, 9 aa, Homo Sapiens
LASGRGCLL

SEQ ID NO: 1396333 - protein, 9 aa, Homo Sapiens
EWLVCLYHP

SEQ ID NO: 1396334 - protein, 9 aa, Homo Sapiens
ECMTAHSGT

SEQ ID NO: 1396335 - protein, 9 aa, Homo Sapiens
TPPQRVQTP

SEQ ID NO: 1396336 - protein, 9 aa, Homo Sapiens
KYMQAVWQD

SEQ ID NO: 1396337 - protein, 9 aa, Homo Sapiens
ASPLKRDPQ

SEQ ID NO: 1396338 - protein, 9 aa, Homo Sapiens
WTEASLRRM

SEQ ID NO: 1396339 - protein, 9 aa, Homo Sapiens
FFFCLRGHP

SEQ ID NO: 1396340 - protein, 9 aa, Homo Sapiens
TYQPEPGHT

SEQ ID NO: 1396341 - protein, 9 aa, Homo Sapiens
VSQAVIADG

SEQ ID NO: 1396342 - protein, 9 aa, Homo Sapiens
GHPSAFNNL

SEQ ID NO: 1396343 - protein, 9 aa, Homo Sapiens
SSGEKISSW

SEQ ID NO: 1396344 - protein, 9 aa, Homo Sapiens
SRRTSLSAR

SEQ ID NO: 1396345 - protein, 9 aa, Homo Sapiens
AARSQLPWP

SEQ ID NO: 1396346 - protein, 9 aa, Homo Sapiens
KKLVKISEI

SEQ ID NO: 1396347 - protein, 9 aa, Homo Sapiens
VCVLPTRIA

SEQ ID NO: 1396348 - protein, 9 aa, Homo Sapiens
LTVVTRVWH

SEQ ID NO: 1396349 - protein, 9 aa, Homo Sapiens
AGYGGAHPT

SEQ ID NO: 1396350 - protein, 9 aa, Homo Sapiens
IKAGQAGHH

SEQ ID NO: 1396351 - protein, 9 aa, Homo Sapiens
DSEDEKGGA

SEQ ID NO: 1396352 - protein, 9 aa, Homo Sapiens
RSNVAIPAN

SEQ ID NO: 1396353 - protein, 9 aa, Homo Sapiens
PAPSAGRTS

SEQ ID NO: 1396354 - protein, 9 aa, Homo Sapiens
GLLLLEVKL

SEQ ID NO: 1396355 - protein, 9 aa, Homo Sapiens
ESLRKERAQ

SEQ ID NO: 1396356 - protein, 9 aa, Homo Sapiens
TPEASGGAW

SEQ ID NO: 1396357 - protein, 9 aa, Homo Sapiens
SSESHISSA

SEQ ID NO: 1396358 - protein, 9 aa, Homo Sapiens
TWLERQEAR

SEQ ID NO: 1396359 - protein, 9 aa, Homo Sapiens
ARPSATNPT

SEQ ID NO: 1396360 - protein, 9 aa, Homo Sapiens
LESSGYSII

SEQ ID NO: 1396361 - protein, 9 aa, Homo Sapiens
PPTLPWTLR

SEQ ID NO: 1396362 - protein, 9 aa, Homo Sapiens
IFVMCWLPY

SEQ ID NO: 1396363 - protein, 9 aa, Homo Sapiens
VSTRKNGGG

SEQ ID NO: 1396364 - protein, 9 aa, Homo Sapiens
FHFPHCSET

SEQ ID NO: 1396365 - protein, 9 aa, Homo Sapiens
VQNEPAQRE

SEQ ID NO: 1396366 - protein, 9 aa, Homo Sapiens
GIYRWPGDS

SEQ ID NO: 1396367 - protein, 9 aa, Homo Sapiens
SHTNTSHIM

SEQ ID NO: 1396368 - protein, 9 aa, Homo Sapiens
DKKETKFQL

SEQ ID NO: 1396369 - protein, 9 aa, Homo Sapiens
QSTAPSPSV

SEQ ID NO: 1396370 - protein, 9 aa, Homo Sapiens
SDRQDWQNL

SEQ ID NO: 1396371 - protein, 9 aa, Homo Sapiens
AMHPYYLPN

SEQ ID NO: 1396372 - protein, 9 aa, Homo Sapiens
KNLIPCGPA

SEQ ID NO: 1396373 - protein, 9 aa, Homo Sapiens
IGVVHLVLH

SEQ ID NO: 1396374 - protein, 9 aa, Homo Sapiens
KICCPHSRE

SEQ ID NO: 1396375 - protein, 9 aa, Homo Sapiens
SSTGKTGWS

SEQ ID NO: 1396376 - protein, 9 aa, Homo Sapiens
LEKYMQAVW

SEQ ID NO: 1396377 - protein, 9 aa, Homo Sapiens
VDYHRLDQN

SEQ ID NO: 1396378 - protein, 9 aa, Homo Sapiens
GPPRTREET

SEQ ID NO: 1396379 - protein, 9 aa, Homo Sapiens
LEQLFSQYE

SEQ ID NO: 1396380 - protein, 9 aa, Homo Sapiens
RERRATRIA

SEQ ID NO: 1396381 - protein, 9 aa, Homo Sapiens
CTTQRILAL

SEQ ID NO: 1396382 - protein, 9 aa, Homo Sapiens
VFSAPACLL

SEQ ID NO: 1396383 - protein, 9 aa, Homo Sapiens
EWNLKSGCV

SEQ ID NO: 1396384 - protein, 9 aa, Homo Sapiens
VTLLYVNTV

SEQ ID NO: 1396385 - protein, 9 aa, Homo Sapiens
QGDKANFFQ

SEQ ID NO: 1396386 - protein, 9 aa, Homo Sapiens
GLHLHRQIS

SEQ ID NO: 1396387 - protein, 9 aa, Homo Sapiens
SESMKKVKC

SEQ ID NO: 1396388 - protein, 9 aa, Homo Sapiens
IYRWPGDSD

SEQ ID NO: 1396389 - protein, 9 aa, Homo Sapiens
LGGGPRAID

SEQ ID NO: 1396390 - protein, 9 aa, Homo Sapiens
TGKTGWSTR

SEQ ID NO: 1396391 - protein, 9 aa, Homo Sapiens
RVPDEADSP

SEQ ID NO: 1396392 - protein, 9 aa, Homo Sapiens
VYFTQESSI

SEQ ID NO: 1396393 - protein, 9 aa, Homo Sapiens
LLTLLLTST

SEQ ID NO: 1396394 - protein, 9 aa, Homo Sapiens
NVQIATKLR

SEQ ID NO: 1396395 - protein, 9 aa, Homo Sapiens
AMVNYFVSH

SEQ ID NO: 1396396 - protein, 9 aa, Homo Sapiens
VEILELAGN

SEQ ID NO: 1396397 - protein, 9 aa, Homo Sapiens
WRAQALLAG

SEQ ID NO: 1396398 - protein, 9 aa, Homo Sapiens
WRAGSSGNS

SEQ ID NO: 1396399 - protein, 9 aa, Homo Sapiens
RRGSTARGC

SEQ ID NO: 1396400 - protein, 9 aa, Homo Sapiens
ELFVQQPEF

SEQ ID NO: 1396401 - protein, 9 aa, Homo Sapiens
QMVISNPAA

SEQ ID NO: 1396402 - protein, 9 aa, Homo Sapiens
APSAFDRNF

SEQ ID NO: 1396403 - protein, 9 aa, Homo Sapiens
GGDGPWGRS

SEQ ID NO: 1396404 - protein, 9 aa, Homo Sapiens
ASGSENHKV

SEQ ID NO: 1396405 - protein, 9 aa, Homo Sapiens
LHLHRQISL

SEQ ID NO: 1396406 - protein, 9 aa, Homo Sapiens
GRPPAASGC

SEQ ID NO: 1396407 - protein, 9 aa, Homo Sapiens
LLGVCGHLK

SEQ ID NO: 1396408 - protein, 9 aa, Homo Sapiens
QQMSSWATC

SEQ ID NO: 1396409 - protein, 9 aa, Homo Sapiens
DFLMSHPRL

SEQ ID NO: 1396410 - protein, 9 aa, Homo Sapiens
GPVDAGRYE

SEQ ID NO: 1396411 - protein, 9 aa, Homo Sapiens
YISLILGAW

SEQ ID NO: 1396412 - protein, 9 aa, Homo Sapiens
QGLTFPGWF

SEQ ID NO: 1396413 - protein, 9 aa, Homo Sapiens
GGVNMDHSI

SEQ ID NO: 1396414 - protein, 9 aa, Homo Sapiens
HREDILNAG

SEQ ID NO: 1396415 - protein, 9 aa, Homo Sapiens
RKGECNHPW

SEQ ID NO: 1396416 - protein, 9 aa, Homo Sapiens
GNARRTAGS

SEQ ID NO: 1396417 - protein, 9 aa, Homo Sapiens
YERIITSRI

SEQ ID NO: 1396418 - protein, 9 aa, Homo Sapiens
AGHHSQPVQ

SEQ ID NO: 1396419 - protein, 9 aa, Homo Sapiens
TDDLDVGDC

SEQ ID NO: 1396420 - protein, 9 aa, Homo Sapiens
GSENHKVYI

SEQ ID NO: 1396421 - protein, 9 aa, Homo Sapiens
FFRCSIRKS

SEQ ID NO: 1396422 - protein, 9 aa, Homo Sapiens
TMRTQTAAT

SEQ ID NO: 1396423 - protein, 9 aa, Homo Sapiens
VYIMSTTGW

SEQ ID NO: 1396424 - protein, 9 aa, Homo Sapiens
ETTVMSLGE

SEQ ID NO: 1396425 - protein, 9 aa, Homo Sapiens
TPHSPDPSM

SEQ ID NO: 1396426 - protein, 9 aa, Homo Sapiens
LEHFLISAF

SEQ ID NO: 1396427 - protein, 9 aa, Homo Sapiens
LVDKHEKKS

SEQ ID NO: 1396428 - protein, 9 aa, Homo Sapiens
FVLVNLEVT

SEQ ID NO: 1396429 - protein, 9 aa, Homo Sapiens
QLATSSQDM

SEQ ID NO: 1396430 - protein, 9 aa, Homo Sapiens
ETKFQLIII

SEQ ID NO: 1396431 - protein, 9 aa, Homo Sapiens
VWPALLGSG

SEQ ID NO: 1396432 - protein, 9 aa, Homo Sapiens
VLRSWQLDA

SEQ ID NO: 1396433 - protein, 9 aa, Homo Sapiens
IYSEFRKIF

SEQ ID NO: 1396434 - protein, 9 aa, Homo Sapiens
SPSGGAEGG

SEQ ID NO: 1396435 - protein, 9 aa, Homo Sapiens
SFFSTPEGY

SEQ ID NO: 1396436 - protein, 9 aa, Homo Sapiens
YLKSPPSAP

SEQ ID NO: 1396437 - protein, 9 aa, Homo Sapiens
LLGPVLLSR

SEQ ID NO: 1396438 - protein, 9 aa, Homo Sapiens
SPVIEYSVG

SEQ ID NO: 1396439 - protein, 9 aa, Homo Sapiens
VVFVGNFLH

SEQ ID NO: 1396440 - protein, 9 aa, Homo Sapiens
TRYAQSRMH

SEQ ID NO: 1396441 - protein, 9 aa, Homo Sapiens
QVCPEQFAH

SEQ ID NO: 1396442 - protein, 9 aa, Homo Sapiens
TFLPVKGIT

SEQ ID NO: 1396443 - protein, 9 aa, Homo Sapiens
LQGLVAGVG

SEQ ID NO: 1396444 - protein, 9 aa, Homo Sapiens
RRLLLPRLH

SEQ ID NO: 1396445 - protein, 9 aa, Homo Sapiens
KNHDHPDQR

SEQ ID NO: 1396446 - protein, 9 aa, Homo Sapiens
GPTPVPTAT

SEQ ID NO: 1396447 - protein, 9 aa, Homo Sapiens
GGPSSSAPT

SEQ ID NO: 1396448 - protein, 9 aa, Homo Sapiens
QTIYGAETR

SEQ ID NO: 1396449 - protein, 9 aa, Homo Sapiens
LECIASVRP

SEQ ID NO: 1396450 - protein, 9 aa, Homo Sapiens
RRGGCPGLV

SEQ ID NO: 1396451 - protein, 9 aa, Homo Sapiens
WLGGGPRAI

SEQ ID NO: 1396452 - protein, 9 aa, Homo Sapiens
RASRKTWQR

SEQ ID NO: 1396453 - protein, 9 aa, Homo Sapiens
RLVIVGHGH

SEQ ID NO: 1396454 - protein, 9 aa, Homo Sapiens
ASGWSASCG

SEQ ID NO: 1396455 - protein, 9 aa, Homo Sapiens
AAPTGAAGA

SEQ ID NO: 1396456 - protein, 9 aa, Homo Sapiens
QGGVIKAGQ

SEQ ID NO: 1396457 - protein, 9 aa, Homo Sapiens
GFNKKRKKM

SEQ ID NO: 1396458 - protein, 9 aa, Homo Sapiens
SVFSAPACL

SEQ ID NO: 1396459 - protein, 9 aa, Homo Sapiens
MFGSALQVM

SEQ ID NO: 1396460 - protein, 9 aa, Homo Sapiens
GDCPKRPEQ

SEQ ID NO: 1396461 - protein, 9 aa, Homo Sapiens
QSEDGVRAP

SEQ ID NO: 1396462 - protein, 9 aa, Homo Sapiens
GAAAAAPTG

SEQ ID NO: 1396463 - protein, 9 aa, Homo Sapiens
DSDVSLHCS

SEQ ID NO: 1396464 - protein, 9 aa, Homo Sapiens
YRSCAVNKG

SEQ ID NO: 1396465 - protein, 9 aa, Homo Sapiens
TSDPSEELE

SEQ ID NO: 1396466 - protein, 9 aa, Homo Sapiens
QQQQPHHLP

SEQ ID NO: 1396467 - protein, 9 aa, Homo Sapiens
YTQMPNTAR

SEQ ID NO: 1396468 - protein, 9 aa, Homo Sapiens
QPQQQQQQP

SEQ ID NO: 1396469 - protein, 9 aa, Homo Sapiens
EERYRPNME

SEQ ID NO: 1396470 - protein, 9 aa, Homo Sapiens
MVFYSRDTK

SEQ ID NO: 1396471 - protein, 9 aa, Homo Sapiens
CSQGSLFVE

SEQ ID NO: 1396472 - protein, 9 aa, Homo Sapiens
KRPEQLPQH

SEQ ID NO: 1396473 - protein, 9 aa, Homo Sapiens
QENLSKVIP

SEQ ID NO: 1396474 - protein, 9 aa, Homo Sapiens
RYPSLLEQQ

SEQ ID NO: 1396475 - protein, 9 aa, Homo Sapiens
EFVNISRVE

SEQ ID NO: 1396476 - protein, 9 aa, Homo Sapiens
QLCQAIEEL

SEQ ID NO: 1396477 - protein, 9 aa, Homo Sapiens
AKEVEHTVS

SEQ ID NO: 1396478 - protein, 9 aa, Homo Sapiens
EGAFNDNEK

SEQ ID NO: 1396479 - protein, 9 aa, Homo Sapiens
GLMAHAFPP

SEQ ID NO: 1396480 - protein, 9 aa, Homo Sapiens
VMCYTASIM

SEQ ID NO: 1396481 - protein, 9 aa, Homo Sapiens
KMDLDGMLT

SEQ ID NO: 1396482 - protein, 9 aa, Homo Sapiens
TCHLRTRID

SEQ ID NO: 1396483 - protein, 9 aa, Homo Sapiens
KPWLLRYPS

SEQ ID NO: 1396484 - protein, 9 aa, Homo Sapiens
RGIDRVTIY

SEQ ID NO: 1396485 - protein, 9 aa, Homo Sapiens
AGSTASVGG

SEQ ID NO: 1396486 - protein, 9 aa, Homo Sapiens
STSSSPTGG

SEQ ID NO: 1396487 - protein, 9 aa, Homo Sapiens
RSSENSASS

SEQ ID NO: 1396488 - protein, 9 aa, Homo Sapiens
RNCIPAPVP

SEQ ID NO: 1396489 - protein, 9 aa, Homo Sapiens
AAQMGTVVP

SEQ ID NO: 1396490 - protein, 9 aa, Homo Sapiens
CRSYWTSWR

SEQ ID NO: 1396491 - protein, 9 aa, Homo Sapiens
CRQLALGMP

SEQ ID NO: 1396492 - protein, 9 aa, Homo Sapiens
QKTPNFSAL

SEQ ID NO: 1396493 - protein, 9 aa, Homo Sapiens
TPSSEPKEE

SEQ ID NO: 1396494 - protein, 9 aa, Homo Sapiens
DSTFEENMH

SEQ ID NO: 1396495 - protein, 9 aa, Homo Sapiens
PKRQELEKS

SEQ ID NO: 1396496 - protein, 9 aa, Homo Sapiens
PLYRSPHPS

SEQ ID NO: 1396497 - protein, 9 aa, Homo Sapiens
VQYICDRGF

SEQ ID NO: 1396498 - protein, 9 aa, Homo Sapiens
DPPKICCPH

SEQ ID NO: 1396499 - protein, 9 aa, Homo Sapiens
TAHAMRERI

SEQ ID NO: 1396500 - protein, 9 aa, Homo Sapiens
ALRARGGTT

SEQ ID NO: 1396501 - protein, 9 aa, Homo Sapiens
SLSLLASHH

SEQ ID NO: 1396502 - protein, 9 aa, Homo Sapiens
CQNINECEH

SEQ ID NO: 1396503 - protein, 9 aa, Homo Sapiens
EHAKNLRVD

SEQ ID NO: 1396504 - protein, 9 aa, Homo Sapiens
HLQNSVLQA

SEQ ID NO: 1396505 - protein, 9 aa, Homo Sapiens
MRERIRVEA

SEQ ID NO: 1396506 - protein, 9 aa, Homo Sapiens
SSKLGIRGS

SEQ ID NO: 1396507 - protein, 9 aa, Homo Sapiens
VQRTVAHQI

SEQ ID NO: 1396508 - protein, 9 aa, Homo Sapiens
SATDSEDEK

SEQ ID NO: 1396509 - protein, 9 aa, Homo Sapiens
SSQSTAPSP

SEQ ID NO: 1396510 - protein, 9 aa, Homo Sapiens
ISEADLVRP

SEQ ID NO: 1396511 - protein, 9 aa, Homo Sapiens
LFVLSYQDP

SEQ ID NO: 1396512 - protein, 9 aa, Homo Sapiens
LRPLSGPPP

SEQ ID NO: 1396513 - protein, 9 aa, Homo Sapiens
TMKRPFLWD

SEQ ID NO: 1396514 - protein, 9 aa, Homo Sapiens
PSGEQIPGL

SEQ ID NO: 1396515 - protein, 9 aa, Homo Sapiens
RLFQPDLCN

SEQ ID NO: 1396516 - protein, 9 aa, Homo Sapiens
SVQQHREDI

SEQ ID NO: 1396517 - protein, 9 aa, Homo Sapiens
PARSPTSAP

SEQ ID NO: 1396518 - protein, 9 aa, Homo Sapiens
TTTTSSPRR

SEQ ID NO: 1396519 - protein, 9 aa, Homo Sapiens
VWHPAIPAH

SEQ ID NO: 1396520 - protein, 9 aa, Homo Sapiens
SHIMQYGNK

SEQ ID NO: 1396521 - protein, 9 aa, Homo Sapiens
LLPRLHVRR

SEQ ID NO: 1396522 - protein, 9 aa, Homo Sapiens
VMKTGSDMF

SEQ ID NO: 1396523 - protein, 9 aa, Homo Sapiens
LPVGAMVNM

SEQ ID NO: 1396524 - protein, 9 aa, Homo Sapiens
GMPGGLAGA

SEQ ID NO: 1396525 - protein, 9 aa, Homo Sapiens
RQFVACLVL

SEQ ID NO: 1396526 - protein, 9 aa, Homo Sapiens
ECRIEIEEN

SEQ ID NO: 1396527 - protein, 9 aa, Homo Sapiens
SAFNNLKNC

SEQ ID NO: 1396528 - protein, 9 aa, Homo Sapiens
VIASLPDLP

SEQ ID NO: 1396529 - protein, 9 aa, Homo Sapiens
YKIDSLIGK

SEQ ID NO: 1396530 - protein, 9 aa, Homo Sapiens
ICDSCTVNN

SEQ ID NO: 1396531 - protein, 9 aa, Homo Sapiens
TSSSPTGGG

SEQ ID NO: 1396532 - protein, 9 aa, Homo Sapiens
TMNRICVLD

SEQ ID NO: 1396533 - protein, 9 aa, Homo Sapiens
DLINKITPP

SEQ ID NO: 1396534 - protein, 9 aa, Homo Sapiens
YGESQRWKI

SEQ ID NO: 1396535 - protein, 9 aa, Homo Sapiens
RWPGDSDVS

SEQ ID NO: 1396536 - protein, 9 aa, Homo Sapiens
VAVVPLGTW

SEQ ID NO: 1396537 - protein, 9 aa, Homo Sapiens
AYVAIFVMC

SEQ ID NO: 1396538 - protein, 9 aa, Homo Sapiens
ASSASSKED

SEQ ID NO: 1396539 - protein, 9 aa, Homo Sapiens
PSGGAEGGG

SEQ ID NO: 1396540 - protein, 9 aa, Homo Sapiens
EYSYQDIQK

SEQ ID NO: 1396541 - protein, 9 aa, Homo Sapiens
VLLSSVLRS

SEQ ID NO: 1396542 - protein, 9 aa, Homo Sapiens
VLCFELERT

SEQ ID NO: 1396543 - protein, 9 aa, Homo Sapiens
LEIASTYLI

SEQ ID NO: 1396544 - protein, 9 aa, Homo Sapiens
TRKESRGAH

SEQ ID NO: 1396545 - protein, 9 aa, Homo Sapiens
ITCRLYSGY

SEQ ID NO: 1396546 - protein, 9 aa, Homo Sapiens
FSWRAGSSG

SEQ ID NO: 1396547 - protein, 9 aa, Homo Sapiens
AGTASHKST

SEQ ID NO: 1396548 - protein, 9 aa, Homo Sapiens
AKPSARSPT

SEQ ID NO: 1396549 - protein, 9 aa, Homo Sapiens
KPVWSLLNW

SEQ ID NO: 1396550 - protein, 9 aa, Homo Sapiens
PLSTLKPPA

SEQ ID NO: 1396551 - protein, 9 aa, Homo Sapiens
SRTPIPTGS

SEQ ID NO: 1396552 - protein, 9 aa, Homo Sapiens
SVRADTYCH

SEQ ID NO: 1396553 - protein, 9 aa, Homo Sapiens
LGGHRLCVR

SEQ ID NO: 1396554 - protein, 9 aa, Homo Sapiens
IKPLPPNTK

SEQ ID NO: 1396555 - protein, 9 aa, Homo Sapiens
EVVAERLEA

SEQ ID NO: 1396556 - protein, 9 aa, Homo Sapiens
CGTMFTNSG

SEQ ID NO: 1396557 - protein, 9 aa, Homo Sapiens
LKNGLHTSP

SEQ ID NO: 1396558 - protein, 9 aa, Homo Sapiens
CFFTSLFVP

SEQ ID NO: 1396559 - protein, 9 aa, Homo Sapiens
VSVGGGDVE

SEQ ID NO: 1396560 - protein, 9 aa, Homo Sapiens
AHFQDVRGQ

SEQ ID NO: 1396561 - protein, 9 aa, Homo Sapiens
YIASTRLFT

SEQ ID NO: 1396562 - protein, 9 aa, Homo Sapiens
STPPQRVQT

SEQ ID NO: 1396563 - protein, 9 aa, Homo Sapiens
GAQGSGGDT

SEQ ID NO: 1396564 - protein, 9 aa, Homo Sapiens
EYDESVEDA

SEQ ID NO: 1396565 - protein, 9 aa, Homo Sapiens
FTSDNGGHP

SEQ ID NO: 1396566 - protein, 9 aa, Homo Sapiens
HAIRGEEAA

SEQ ID NO: 1396567 - protein, 9 aa, Homo Sapiens
LDRNLGSPL

SEQ ID NO: 1396568 - protein, 9 aa, Homo Sapiens
CDSCTVNNH

SEQ ID NO: 1396569 - protein, 9 aa, Homo Sapiens
QGLKAAIKR

SEQ ID NO: 1396570 - protein, 9 aa, Homo Sapiens
TQLTRLMRR

SEQ ID NO: 1396571 - protein, 9 aa, Homo Sapiens
EYLTVEILE

SEQ ID NO: 1396572 - protein, 9 aa, Homo Sapiens
KLYDIAKNA

SEQ ID NO: 1396573 - protein, 9 aa, Homo Sapiens
DYHRLDQNV

SEQ ID NO: 1396574 - protein, 9 aa, Homo Sapiens
AGFLSRPAW

SEQ ID NO: 1396575 - protein, 9 aa, Homo Sapiens
RAYPIQVLT

SEQ ID NO: 1396576 - protein, 9 aa, Homo Sapiens
QSIKRKFHF

SEQ ID NO: 1396577 - protein, 9 aa, Homo Sapiens
KIEEKDPKK

SEQ ID NO: 1396578 - protein, 9 aa, Homo Sapiens
GSIRQFVAC

SEQ ID NO: 1396579 - protein, 9 aa, Homo Sapiens
PAVAVPTPE

SEQ ID NO: 1396580 - protein, 9 aa, Homo Sapiens
RAVEKVKKL

SEQ ID NO: 1396581 - protein, 9 aa, Homo Sapiens
CCHHWNKVL

SEQ ID NO: 1396582 - protein, 9 aa, Homo Sapiens
EKDPKKRSK

SEQ ID NO: 1396583 - protein, 9 aa, Homo Sapiens
FFSKRIKSA

SEQ ID NO: 1396584 - protein, 9 aa, Homo Sapiens
GWLYCMKVL

SEQ ID NO: 1396585 - protein, 9 aa, Homo Sapiens
EKTSKRDGK

SEQ ID NO: 1396586 - protein, 9 aa, Homo Sapiens
TMFTNSGNL

SEQ ID NO: 1396587 - protein, 9 aa, Homo Sapiens
PTTEGVSPP

SEQ ID NO: 1396588 - protein, 9 aa, Homo Sapiens
YEEMKNLNF

SEQ ID NO: 1396589 - protein, 9 aa, Homo Sapiens
VSVELLRAA

SEQ ID NO: 1396590 - protein, 9 aa, Homo Sapiens
PYCISIARR

SEQ ID NO: 1396591 - protein, 9 aa, Homo Sapiens
ERTISSCLG

SEQ ID NO: 1396592 - protein, 9 aa, Homo Sapiens
QKPGAHSSH

SEQ ID NO: 1396593 - protein, 9 aa, Homo Sapiens
MVARCKREH

SEQ ID NO: 1396594 - protein, 9 aa, Homo Sapiens
TEAWGARRG

SEQ ID NO: 1396595 - protein, 9 aa, Homo Sapiens
LRKKIEEAM

SEQ ID NO: 1396596 - protein, 9 aa, Homo Sapiens
DKRVLVIGL

SEQ ID NO: 1396597 - protein, 9 aa, Homo Sapiens
CVVKDLSSE

SEQ ID NO: 1396598 - protein, 9 aa, Homo Sapiens
SMTRFWRWS

SEQ ID NO: 1396599 - protein, 9 aa, Homo Sapiens
GLKAAIKRQ

SEQ ID NO: 1396600 - protein, 9 aa, Homo Sapiens
SVELLRAAL

SEQ ID NO: 1396601 - protein, 9 aa, Homo Sapiens
LRATVPRHS

SEQ ID NO: 1396602 - protein, 9 aa, Homo Sapiens
ATSAQSLHP

SEQ ID NO: 1396603 - protein, 9 aa, Homo Sapiens
NSLTILDDE

SEQ ID NO: 1396604 - protein, 9 aa, Homo Sapiens
KKDKKETKF

SEQ ID NO: 1396605 - protein, 9 aa, Homo Sapiens
SFGTRASSN

SEQ ID NO: 1396606 - protein, 9 aa, Homo Sapiens
FMNIQEDIL

SEQ ID NO: 1396607 - protein, 9 aa, Homo Sapiens
STILFWTPP

SEQ ID NO: 1396608 - protein, 9 aa, Homo Sapiens
FKEHFSLRN

SEQ ID NO: 1396609 - protein, 9 aa, Homo Sapiens
LPATLCLLQ

SEQ ID NO: 1396610 - protein, 9 aa, Homo Sapiens
WQPACGALW

SEQ ID NO: 1396611 - protein, 9 aa, Homo Sapiens
GARGPTPPR

SEQ ID NO: 1396612 - protein, 9 aa, Homo Sapiens
KNLPLCSHF

SEQ ID NO: 1396613 - protein, 9 aa, Homo Sapiens
EVTVTVLSQ

SEQ ID NO: 1396614 - protein, 9 aa, Homo Sapiens
ARGGTTIGE

SEQ ID NO: 1396615 - protein, 9 aa, Homo Sapiens
LLEAFPLPR

SEQ ID NO: 1396616 - protein, 9 aa, Homo Sapiens
AVQTMNRIC

SEQ ID NO: 1396617 - protein, 9 aa, Homo Sapiens
GSGRGSNSW

SEQ ID NO: 1396618 - protein, 9 aa, Homo Sapiens
QQGGAPSAF

SEQ ID NO: 1396619 - protein, 9 aa, Homo Sapiens
GSIIAEVHA

SEQ ID NO: 1396620 - protein, 9 aa, Homo Sapiens
PPASPLKRD

SEQ ID NO: 1396621 - protein, 9 aa, Homo Sapiens
EPAPAASMR

SEQ ID NO: 1396622 - protein, 9 aa, Homo Sapiens
ALCLICCGY

SEQ ID NO: 1396623 - protein, 9 aa, Homo Sapiens
FKKFAEQDV

SEQ ID NO: 1396624 - protein, 9 aa, Homo Sapiens
NWKFSGVTS

SEQ ID NO: 1396625 - protein, 9 aa, Homo Sapiens
RECRIEIEE

SEQ ID NO: 1396626 - protein, 9 aa, Homo Sapiens
DSNLNTTCL

SEQ ID NO: 1396627 - protein, 9 aa, Homo Sapiens
LEDLKIYLQ

SEQ ID NO: 1396628 - protein, 9 aa, Homo Sapiens
LLGSPLLSG

SEQ ID NO: 1396629 - protein, 9 aa, Homo Sapiens
SLFYTYKGK

SEQ ID NO: 1396630 - protein, 9 aa, Homo Sapiens
ARSPTWCRT

SEQ ID NO: 1396631 - protein, 9 aa, Homo Sapiens
RQELEKSNG

SEQ ID NO: 1396632 - protein, 9 aa, Homo Sapiens
TSYPHSAWC

SEQ ID NO: 1396633 - protein, 9 aa, Homo Sapiens
AGPNKILRS

SEQ ID NO: 1396634 - protein, 9 aa, Homo Sapiens
IRGEEAALQ

SEQ ID NO: 1396635 - protein, 9 aa, Homo Sapiens
PRSCSEAAS

SEQ ID NO: 1396636 - protein, 9 aa, Homo Sapiens
RSRRHRDRH

SEQ ID NO: 1396637 - protein, 9 aa, Homo Sapiens
RPCWSRCSL

SEQ ID NO: 1396638 - protein, 9 aa, Homo Sapiens
EQRFVQGHF

SEQ ID NO: 1396639 - protein, 9 aa, Homo Sapiens
GAGCGGGNA

SEQ ID NO: 1396640 - protein, 9 aa, Homo Sapiens
HHSMTRFWR

SEQ ID NO: 1396641 - protein, 9 aa, Homo Sapiens
ECIASVRPV

SEQ ID NO: 1396642 - protein, 9 aa, Homo Sapiens
EKLFQLGPL

SEQ ID NO: 1396643 - protein, 9 aa, Homo Sapiens
CCLRLKVTV

SEQ ID NO: 1396644 - protein, 9 aa, Homo Sapiens
NDLDSFSEG

SEQ ID NO: 1396645 - protein, 9 aa, Homo Sapiens
THKRPRFQM

SEQ ID NO: 1396646 - protein, 9 aa, Homo Sapiens
QGILGSTGC

SEQ ID NO: 1396647 - protein, 9 aa, Homo Sapiens
DVCDFIDNL

SEQ ID NO: 1396648 - protein, 9 aa, Homo Sapiens
GSCRRWRAP

SEQ ID NO: 1396649 - protein, 9 aa, Homo Sapiens
VPSVARPST

SEQ ID NO: 1396650 - protein, 9 aa, Homo Sapiens
QDPRLPAPH

SEQ ID NO: 1396651 - protein, 9 aa, Homo Sapiens
KKKCRSYWT

SEQ ID NO: 1396652 - protein, 9 aa, Homo Sapiens
MGTARPSES

SEQ ID NO: 1396653 - protein, 9 aa, Homo Sapiens
NMEGYRAPS

SEQ ID NO: 1396654 - protein, 9 aa, Homo Sapiens
TGAAGAASR

SEQ ID NO: 1396655 - protein, 9 aa, Homo Sapiens
CTWNPSQIS

SEQ ID NO: 1396656 - protein, 9 aa, Homo Sapiens
SMPSSCTAT

SEQ ID NO: 1396657 - protein, 9 aa, Homo Sapiens
SCQNINECE

SEQ ID NO: 1396658 - protein, 9 aa, Homo Sapiens
RVQKNLPLC

SEQ ID NO: 1396659 - protein, 9 aa, Homo Sapiens
NKRLEKPSA

SEQ ID NO: 1396660 - protein, 9 aa, Homo Sapiens
RRRECRIEI

SEQ ID NO: 1396661 - protein, 9 aa, Homo Sapiens
CYDAQLYKG

SEQ ID NO: 1396662 - protein, 9 aa, Homo Sapiens
CSEAASLVE

SEQ ID NO: 1396663 - protein, 9 aa, Homo Sapiens
FSSPSSCNP

SEQ ID NO: 1396664 - protein, 9 aa, Homo Sapiens
QRPRQPSQQ

SEQ ID NO: 1396665 - protein, 9 aa, Homo Sapiens
TVEILELAG

SEQ ID NO: 1396666 - protein, 9 aa, Homo Sapiens
AAVFFGYTF

SEQ ID NO: 1396667 - protein, 9 aa, Homo Sapiens
ERRRECRIE

SEQ ID NO: 1396668 - protein, 9 aa, Homo Sapiens
DSFELISFK

SEQ ID NO: 1396669 - protein, 9 aa, Homo Sapiens
SARRRTWWR

SEQ ID NO: 1396670 - protein, 9 aa, Homo Sapiens
ITDDLDVGD

SEQ ID NO: 1396671 - protein, 9 aa, Homo Sapiens
YTDRALQAS

SEQ ID NO: 1396672 - protein, 9 aa, Homo Sapiens
VCYDLTRER

SEQ ID NO: 1396673 - protein, 9 aa, Homo Sapiens
RKSRLRDPS

SEQ ID NO: 1396674 - protein, 9 aa, Homo Sapiens
EHYWEEKEQ

SEQ ID NO: 1396675 - protein, 9 aa, Homo Sapiens
EYMFNSNSG

SEQ ID NO: 1396676 - protein, 9 aa, Homo Sapiens
LSRWTEASL

SEQ ID NO: 1396677 - protein, 9 aa, Homo Sapiens
KSPPSAPAS

SEQ ID NO: 1396678 - protein, 9 aa, Homo Sapiens
QGPAPPPNA

SEQ ID NO: 1396679 - protein, 9 aa, Homo Sapiens
ERLEAMEPP

SEQ ID NO: 1396680 - protein, 9 aa, Homo Sapiens
PARSARRWT

SEQ ID NO: 1396681 - protein, 9 aa, Homo Sapiens
QMLPSSCPL

SEQ ID NO: 1396682 - protein, 9 aa, Homo Sapiens
SLADYPAVP

SEQ ID NO: 1396683 - protein, 9 aa, Homo Sapiens
PSMTTSCLK

SEQ ID NO: 1396684 - protein, 9 aa, Homo Sapiens
NGCPDSGMP

SEQ ID NO: 1396685 - protein, 9 aa, Homo Sapiens
AGPRIKCVW

SEQ ID NO: 1396686 - protein, 9 aa, Homo Sapiens
LLSRWTEAS

SEQ ID NO: 1396687 - protein, 9 aa, Homo Sapiens
KFDAGTLLS

SEQ ID NO: 1396688 - protein, 9 aa, Homo Sapiens
IGPSCVPTA

SEQ ID NO: 1396689 - protein, 9 aa, Homo Sapiens
PAATIAPVE

SEQ ID NO: 1396690 - protein, 9 aa, Homo Sapiens
SQSQDPRLP

SEQ ID NO: 1396691 - protein, 9 aa, Homo Sapiens
VASIKVSVE

SEQ ID NO: 1396692 - protein, 9 aa, Homo Sapiens
HYINPRTPP

SEQ ID NO: 1396693 - protein, 9 aa, Homo Sapiens
KSIFRLYSR

SEQ ID NO: 1396694 - protein, 9 aa, Homo Sapiens
MDLDGMLTV

SEQ ID NO: 1396695 - protein, 9 aa, Homo Sapiens
LSSPSDFYS

SEQ ID NO: 1396696 - protein, 9 aa, Homo Sapiens
ERVLKNPPE

SEQ ID NO: 1396697 - protein, 9 aa, Homo Sapiens
VEEMLGLAR

SEQ ID NO: 1396698 - protein, 9 aa, Homo Sapiens
FSSGEKISS

SEQ ID NO: 1396699 - protein, 9 aa, Homo Sapiens
TSARRRTWW

SEQ ID NO: 1396700 - protein, 9 aa, Homo Sapiens
CGSGLGIGG

SEQ ID NO: 1396701 - protein, 9 aa, Homo Sapiens
PHTRLWMAT

SEQ ID NO: 1396702 - protein, 9 aa, Homo Sapiens
IGASDILEE

SEQ ID NO: 1396703 - protein, 9 aa, Homo Sapiens
SCGCTLQYQ

SEQ ID NO: 1396704 - protein, 9 aa, Homo Sapiens
FMQFSLFSV

SEQ ID NO: 1396705 - protein, 9 aa, Homo Sapiens
CMASMSFGA

SEQ ID NO: 1396706 - protein, 9 aa, Homo Sapiens
VNKRLEKPS

SEQ ID NO: 1396707 - protein, 9 aa, Homo Sapiens
APRHPHRSP

SEQ ID NO: 1396708 - protein, 9 aa, Homo Sapiens
YEERVLKNP

SEQ ID NO: 1396709 - protein, 9 aa, Homo Sapiens
SQKLCNSQS

SEQ ID NO: 1396710 - protein, 9 aa, Homo Sapiens
DNEKETMQF

SEQ ID NO: 1396711 - protein, 9 aa, Homo Sapiens
VLAYIQSLP

SEQ ID NO: 1396712 - protein, 9 aa, Homo Sapiens
PAEEVILAL

SEQ ID NO: 1396713 - protein, 9 aa, Homo Sapiens
MTAHSGTTS

SEQ ID NO: 1396714 - protein, 9 aa, Homo Sapiens
DPETPANRY

SEQ ID NO: 1396715 - protein, 9 aa, Homo Sapiens
SYQDPAGEN

SEQ ID NO: 1396716 - protein, 9 aa, Homo Sapiens
DPQPFLRVL

SEQ ID NO: 1396717 - protein, 9 aa, Homo Sapiens
QWMHACGGA

SEQ ID NO: 1396718 - protein, 9 aa, Homo Sapiens
SPRPPPLVR

SEQ ID NO: 1396719 - protein, 9 aa, Homo Sapiens
GVLVRDMLY

SEQ ID NO: 1396720 - protein, 9 aa, Homo Sapiens
ANPSSHRVL

SEQ ID NO: 1396721 - protein, 9 aa, Homo Sapiens
EEMKNLNFS

SEQ ID NO: 1396722 - protein, 9 aa, Homo Sapiens
LQVPRIHRW

SEQ ID NO: 1396723 - protein, 9 aa, Homo Sapiens
VETQSLAAE

SEQ ID NO: 1396724 - protein, 9 aa, Homo Sapiens
SGCPRPLSS

SEQ ID NO: 1396725 - protein, 9 aa, Homo Sapiens
KEVEHTVSE

SEQ ID NO: 1396726 - protein, 9 aa, Homo Sapiens
GAPGLAMPH

SEQ ID NO: 1396727 - protein, 9 aa, Homo Sapiens
TIHEVNMQG

SEQ ID NO: 1396728 - protein, 9 aa, Homo Sapiens
GGSTGDVDG

SEQ ID NO: 1396729 - protein, 9 aa, Homo Sapiens
KWCMASMSF

SEQ ID NO: 1396730 - protein, 9 aa, Homo Sapiens
QQGQFIPSQ

SEQ ID NO: 1396731 - protein, 9 aa, Homo Sapiens
LKSPPSAPA

SEQ ID NO: 1396732 - protein, 9 aa, Homo Sapiens
ALEYDESVE

SEQ ID NO: 1396733 - protein, 9 aa, Homo Sapiens
IQRPIQVQT

SEQ ID NO: 1396734 - protein, 9 aa, Homo Sapiens
RIIYPQRPK

SEQ ID NO: 1396735 - protein, 9 aa, Homo Sapiens
LAASFAVSS

SEQ ID NO: 1396736 - protein, 9 aa, Homo Sapiens
EEWGCPFIE

SEQ ID NO: 1396737 - protein, 9 aa, Homo Sapiens
SPISPVIYD

SEQ ID NO: 1396738 - protein, 9 aa, Homo Sapiens
FNKAFSIKR

SEQ ID NO: 1396739 - protein, 9 aa, Homo Sapiens
LPQGHQGPW

SEQ ID NO: 1396740 - protein, 9 aa, Homo Sapiens
MPAATIAPV

SEQ ID NO: 1396741 - protein, 9 aa, Homo Sapiens
TCRLYSGYL

SEQ ID NO: 1396742 - protein, 9 aa, Homo Sapiens
QISLPLRGF

SEQ ID NO: 1396743 - protein, 9 aa, Homo Sapiens
ARSVEQGCL

SEQ ID NO: 1396744 - protein, 9 aa, Homo Sapiens
QDLQHPVDD

SEQ ID NO: 1396745 - protein, 9 aa, Homo Sapiens
QDVKEEANK

SEQ ID NO: 1396746 - protein, 9 aa, Homo Sapiens
HCGSAACHR

SEQ ID NO: 1396747 - protein, 9 aa, Homo Sapiens
VQTVQQHGR

SEQ ID NO: 1396748 - protein, 9 aa, Homo Sapiens
TCCTVFWAL

SEQ ID NO: 1396749 - protein, 9 aa, Homo Sapiens
WNDGRDPFP

SEQ ID NO: 1396750 - protein, 9 aa, Homo Sapiens
KKCSLYGKK

SEQ ID NO: 1396751 - protein, 9 aa, Homo Sapiens
VRDKKKGQH

SEQ ID NO: 1396752 - protein, 9 aa, Homo Sapiens
KRHKKQSQS

SEQ ID NO: 1396753 - protein, 9 aa, Homo Sapiens
WMHACGGAG

SEQ ID NO: 1396754 - protein, 9 aa, Homo Sapiens
PAKAEQRFV

SEQ ID NO: 1396755 - protein, 9 aa, Homo Sapiens
SSTILFWTP

SEQ ID NO: 1396756 - protein, 9 aa, Homo Sapiens
AKLYDIAKN

SEQ ID NO: 1396757 - protein, 9 aa, Homo Sapiens
PSPAPSAGR

SEQ ID NO: 1396758 - protein, 9 aa, Homo Sapiens
CKGFFRCSI

SEQ ID NO: 1396759 - protein, 9 aa, Homo Sapiens
SQEYSYQDI

SEQ ID NO: 1396760 - protein, 9 aa, Homo Sapiens
IAKNADKVL

SEQ ID NO: 1396761 - protein, 9 aa, Homo Sapiens
LEEQWGALY

SEQ ID NO: 1396762 - protein, 9 aa, Homo Sapiens
KEHFSLRNC

SEQ ID NO: 1396763 - protein, 9 aa, Homo Sapiens
YPIQDTKLP

SEQ ID NO: 1396764 - protein, 9 aa, Homo Sapiens
CTPQPRPSR

SEQ ID NO: 1396765 - protein, 9 aa, Homo Sapiens
PAPLLTWLE

SEQ ID NO: 1396766 - protein, 9 aa, Homo Sapiens
HALPVYIFT

SEQ ID NO: 1396767 - protein, 9 aa, Homo Sapiens
ILEETWEKT

SEQ ID NO: 1396768 - protein, 9 aa, Homo Sapiens
FHKEIAAAC

SEQ ID NO: 1396769 - protein, 9 aa, Homo Sapiens
QLCKCRRPR

SEQ ID NO: 1396770 - protein, 9 aa, Homo Sapiens
RAELSQLFI

SEQ ID NO: 1396771 - protein, 9 aa, Homo Sapiens
QQHREDILN

SEQ ID NO: 1396772 - protein, 9 aa, Homo Sapiens
SQSRPRKSH

SEQ ID NO: 1396773 - protein, 9 aa, Homo Sapiens
ACVGMIAEC

SEQ ID NO: 1396774 - protein, 9 aa, Homo Sapiens
LSLSLVDND

SEQ ID NO: 1396775 - protein, 9 aa, Homo Sapiens
SPVVGQVQA

SEQ ID NO: 1396776 - protein, 9 aa, Homo Sapiens
LWCFPQPPK

SEQ ID NO: 1396777 - protein, 9 aa, Homo Sapiens
SGPSPARSA

SEQ ID NO: 1396778 - protein, 9 aa, Homo Sapiens
HFSLRNCIP

SEQ ID NO: 1396779 - protein, 9 aa, Homo Sapiens
SPALRARGG

SEQ ID NO: 1396780 - protein, 9 aa, Homo Sapiens
VYLVRFYLI

SEQ ID NO: 1396781 - protein, 9 aa, Homo Sapiens
EAETLALVG

SEQ ID NO: 1396782 - protein, 9 aa, Homo Sapiens
LPVKGITEK

SEQ ID NO: 1396783 - protein, 9 aa, Homo Sapiens
LGGGSSYSC

SEQ ID NO: 1396784 - protein, 9 aa, Homo Sapiens
MPSMPSSCT

SEQ ID NO: 1396785 - protein, 9 aa, Homo Sapiens
GSLDRNLGS

SEQ ID NO: 1396786 - protein, 9 aa, Homo Sapiens
LERRGSLTL

SEQ ID NO: 1396787 - protein, 9 aa, Homo Sapiens
FLHVNTLSM

SEQ ID NO: 1396788 - protein, 9 aa, Homo Sapiens
EAVYLVRFY

SEQ ID NO: 1396789 - protein, 9 aa, Homo Sapiens
FLVALTRIA

SEQ ID NO: 1396790 - protein, 9 aa, Homo Sapiens
TYQMTPQSP

SEQ ID NO: 1396791 - protein, 9 aa, Homo Sapiens
LQVMGMQRE

SEQ ID NO: 1396792 - protein, 9 aa, Homo Sapiens
ESQRWKIPI

SEQ ID NO: 1396793 - protein, 9 aa, Homo Sapiens
AREERRREC

SEQ ID NO: 1396794 - protein, 9 aa, Homo Sapiens
LGGWRGWWG

SEQ ID NO: 1396795 - protein, 9 aa, Homo Sapiens
GATAQIQRP

SEQ ID NO: 1396796 - protein, 9 aa, Homo Sapiens
QQILSTYQM

SEQ ID NO: 1396797 - protein, 9 aa, Homo Sapiens
LQIPLTTRN

SEQ ID NO: 1396798 - protein, 9 aa, Homo Sapiens
CRESLGGWR

SEQ ID NO: 1396799 - protein, 9 aa, Homo Sapiens
VLILKIIRR

SEQ ID NO: 1396800 - protein, 9 aa, Homo Sapiens
FRKIFETLR

SEQ ID NO: 1396801 - protein, 9 aa, Homo Sapiens
PQHALVCLR

SEQ ID NO: 1396802 - protein, 9 aa, Homo Sapiens
LKSAGYRSC

SEQ ID NO: 1396803 - protein, 9 aa, Homo Sapiens
AQQQALRFQ

SEQ ID NO: 1396804 - protein, 9 aa, Homo Sapiens
FVDAREREH

SEQ ID NO: 1396805 - protein, 9 aa, Homo Sapiens
EDVASTTHK

SEQ ID NO: 1396806 - protein, 9 aa, Homo Sapiens
QVYFTQESS

SEQ ID NO: 1396807 - protein, 9 aa, Homo Sapiens
TVFWALILV

SEQ ID NO: 1396808 - protein, 9 aa, Homo Sapiens
LLLSPASRS

SEQ ID NO: 1396809 - protein, 9 aa, Homo Sapiens
QRHSVLRGC

SEQ ID NO: 1396810 - protein, 9 aa, Homo Sapiens
GGCHSHHQR

SEQ ID NO: 1396811 - protein, 9 aa, Homo Sapiens
AVDLRKALK

SEQ ID NO: 1396812 - protein, 9 aa, Homo Sapiens
VGSPAKAEQ

SEQ ID NO: 1396813 - protein, 9 aa, Homo Sapiens
SLPQDVCQG

SEQ ID NO: 1396814 - protein, 9 aa, Homo Sapiens
VKLKSVFAK

SEQ ID NO: 1396815 - protein, 9 aa, Homo Sapiens
FVQNSGWLY

SEQ ID NO: 1396816 - protein, 9 aa, Homo Sapiens
PIQDTKLPK

SEQ ID NO: 1396817 - protein, 9 aa, Homo Sapiens
GTTIGEVTS

SEQ ID NO: 1396818 - protein, 9 aa, Homo Sapiens
VCVTSAPNG

SEQ ID NO: 1396819 - protein, 9 aa, Homo Sapiens
VATDLQLST

SEQ ID NO: 1396820 - protein, 9 aa, Homo Sapiens
QEKLVEEML

SEQ ID NO: 1396821 - protein, 9 aa, Homo Sapiens
FYTRFAAYI

SEQ ID NO: 1396822 - protein, 9 aa, Homo Sapiens
GQFIPSQPP

SEQ ID NO: 1396823 - protein, 9 aa, Homo Sapiens
KALSRASFN

SEQ ID NO: 1396824 - protein, 9 aa, Homo Sapiens
VEEEKLLKL

SEQ ID NO: 1396825 - protein, 9 aa, Homo Sapiens
DSHHSGDWW

SEQ ID NO: 1396826 - protein, 9 aa, Homo Sapiens
NLGGRGRQI

SEQ ID NO: 1396827 - protein, 9 aa, Homo Sapiens
GDLQHALAQ

SEQ ID NO: 1396828 - protein, 9 aa, Homo Sapiens
GPETSDPSE

SEQ ID NO: 1396829 - protein, 9 aa, Homo Sapiens
ASDVLQAIQ

SEQ ID NO: 1396830 - protein, 9 aa, Homo Sapiens
YINPRTPPK

SEQ ID NO: 1396831 - protein, 9 aa, Homo Sapiens
DISLRVGLR

SEQ ID NO: 1396832 - protein, 9 aa, Homo Sapiens
PGDIGAELD

SEQ ID NO: 1396833 - protein, 9 aa, Homo Sapiens
VLNKKKCRS

SEQ ID NO: 1396834 - protein, 9 aa, Homo Sapiens
DSETTVMSL

SEQ ID NO: 1396835 - protein, 9 aa, Homo Sapiens
YCDRDTQLT

SEQ ID NO: 1396836 - protein, 9 aa, Homo Sapiens
SHGASCTTQ

SEQ ID NO: 1396837 - protein, 9 aa, Homo Sapiens
VFYSRDTKL

SEQ ID NO: 1396838 - protein, 9 aa, Homo Sapiens
LPRAAPAPP

SEQ ID NO: 1396839 - protein, 9 aa, Homo Sapiens
GGGSLASGA

SEQ ID NO: 1396840 - protein, 9 aa, Homo Sapiens
PHLRQLLHG

SEQ ID NO: 1396841 - protein, 9 aa, Homo Sapiens
GDWWGPSRD

SEQ ID NO: 1396842 - protein, 9 aa, Homo Sapiens
CTNVRDSVT

SEQ ID NO: 1396843 - protein, 9 aa, Homo Sapiens
AGFQQQTEK

SEQ ID NO: 1396844 - protein, 9 aa, Homo Sapiens
SGCGQHPGD

SEQ ID NO: 1396845 - protein, 9 aa, Homo Sapiens
NQFSSGEKI

SEQ ID NO: 1396846 - protein, 9 aa, Homo Sapiens
TARPSESSQ

SEQ ID NO: 1396847 - protein, 9 aa, Homo Sapiens
AAQKCHKKT

SEQ ID NO: 1396848 - protein, 9 aa, Homo Sapiens
ALINSVQQH

SEQ ID NO: 1396849 - protein, 9 aa, Homo Sapiens
DIRREEAGA

SEQ ID NO: 1396850 - protein, 9 aa, Homo Sapiens
DKHEKKSLR

SEQ ID NO: 1396851 - protein, 9 aa, Homo Sapiens
RGSSPVGRL

SEQ ID NO: 1396852 - protein, 9 aa, Homo Sapiens
STAATTAAG

SEQ ID NO: 1396853 - protein, 9 aa, Homo Sapiens
GKVCYDLTR

SEQ ID NO: 1396854 - protein, 9 aa, Homo Sapiens
LEKCYEGTC

SEQ ID NO: 1396855 - protein, 9 aa, Homo Sapiens
NLEHSLLVA

SEQ ID NO: 1396856 - protein, 9 aa, Homo Sapiens
MGGQPREPG

SEQ ID NO: 1396857 - protein, 9 aa, Homo Sapiens
GRTQPSFAP

SEQ ID NO: 1396858 - protein, 9 aa, Homo Sapiens
LLSGARGRT

SEQ ID NO: 1396859 - protein, 9 aa, Homo Sapiens
RGCLLPVWP

SEQ ID NO: 1396860 - protein, 9 aa, Homo Sapiens
MDHSISILG

SEQ ID NO: 1396861 - protein, 9 aa, Homo Sapiens
GSTGDVDGP

SEQ ID NO: 1396862 - protein, 9 aa, Homo Sapiens
FMEFSSPIL

SEQ ID NO: 1396863 - protein, 9 aa, Homo Sapiens
TEDKKNGIW

SEQ ID NO: 1396864 - protein, 9 aa, Homo Sapiens
RSQLPWPAS

SEQ ID NO: 1396865 - protein, 9 aa, Homo Sapiens
ECSVLPRRQ

SEQ ID NO: 1396866 - protein, 9 aa, Homo Sapiens
KEDLLVSWQ

SEQ ID NO: 1396867 - protein, 9 aa, Homo Sapiens
HQELDEVVA

SEQ ID NO: 1396868 - protein, 9 aa, Homo Sapiens
FCNTVHDVV

SEQ ID NO: 1396869 - protein, 9 aa, Homo Sapiens
PPPSPSRRL

SEQ ID NO: 1396870 - protein, 9 aa, Homo Sapiens
LVLFLLLWR

SEQ ID NO: 1396871 - protein, 9 aa, Homo Sapiens
PAPRMRGNL

SEQ ID NO: 1396872 - protein, 9 aa, Homo Sapiens
GIRGSWMGA

SEQ ID NO: 1396873 - protein, 9 aa, Homo Sapiens
GVLPAPRMR

SEQ ID NO: 1396874 - protein, 9 aa, Homo Sapiens
GPSPAPSAG

SEQ ID NO: 1396875 - protein, 9 aa, Homo Sapiens
KASEHACTA

SEQ ID NO: 1396876 - protein, 9 aa, Homo Sapiens
WRTRACTPA

SEQ ID NO: 1396877 - protein, 9 aa, Homo Sapiens
EPLWTIPVT

SEQ ID NO: 1396878 - protein, 9 aa, Homo Sapiens
YTLGAVQIL

SEQ ID NO: 1396879 - protein, 9 aa, Homo Sapiens
GGAWKSIFR

SEQ ID NO: 1396880 - protein, 9 aa, Homo Sapiens
WFFGEQVSR

SEQ ID NO: 1396881 - protein, 9 aa, Homo Sapiens
YIMSTTGWL

SEQ ID NO: 1396882 - protein, 9 aa, Homo Sapiens
PEVTQVPLV

SEQ ID NO: 1396883 - protein, 9 aa, Homo Sapiens
GGRPWCRES

SEQ ID NO: 1396884 - protein, 9 aa, Homo Sapiens
TECVRTALN

SEQ ID NO: 1396885 - protein, 9 aa, Homo Sapiens
RMRHRMRAR

SEQ ID NO: 1396886 - protein, 9 aa, Homo Sapiens
SSAEGGPPE

SEQ ID NO: 1396887 - protein, 9 aa, Homo Sapiens
MSHPRLCRQ

SEQ ID NO: 1396888 - protein, 9 aa, Homo Sapiens
PASRLSTSA

SEQ ID NO: 1396889 - protein, 9 aa, Homo Sapiens
GDPGCQMCA

SEQ ID NO: 1396890 - protein, 9 aa, Homo Sapiens
SKRDGKIIV

SEQ ID NO: 1396891 - protein, 9 aa, Homo Sapiens
ACINSLKES

SEQ ID NO: 1396892 - protein, 9 aa, Homo Sapiens
IRLRFQMIR

SEQ ID NO: 1396893 - protein, 9 aa, Homo Sapiens
GFESTVEKL

SEQ ID NO: 1396894 - protein, 9 aa, Homo Sapiens
RRQSASCGC

SEQ ID NO: 1396895 - protein, 9 aa, Homo Sapiens
KNPPENPEQ

SEQ ID NO: 1396896 - protein, 9 aa, Homo Sapiens
VNTGELMAM

SEQ ID NO: 1396897 - protein, 9 aa, Homo Sapiens
EEEGIYRWP

SEQ ID NO: 1396898 - protein, 9 aa, Homo Sapiens
QPDLCNVDL

SEQ ID NO: 1396899 - protein, 9 aa, Homo Sapiens
LPSILLTLL

SEQ ID NO: 1396900 - protein, 9 aa, Homo Sapiens
EFHYFQQMS

SEQ ID NO: 1396901 - protein, 9 aa, Homo Sapiens
LYSRAVLVE

SEQ ID NO: 1396902 - protein, 9 aa, Homo Sapiens
PAASGCPRP

SEQ ID NO: 1396903 - protein, 9 aa, Homo Sapiens
YYGQEVLIY

SEQ ID NO: 1396904 - protein, 9 aa, Homo Sapiens
TRIDRCRRG

SEQ ID NO: 1396905 - protein, 9 aa, Homo Sapiens
IPAPAKLGS

SEQ ID NO: 1396906 - protein, 9 aa, Homo Sapiens
YDESVEDAN

SEQ ID NO: 1396907 - protein, 9 aa, Homo Sapiens
DEDGLEQDL

SEQ ID NO: 1396908 - protein, 9 aa, Homo Sapiens
TGQLVFLAT

SEQ ID NO: 1396909 - protein, 9 aa, Homo Sapiens
CEASTIVLL

SEQ ID NO: 1396910 - protein, 9 aa, Homo Sapiens
VLIRVISKL

SEQ ID NO: 1396911 - protein, 9 aa, Homo Sapiens
EQSPVVGQV

SEQ ID NO: 1396912 - protein, 9 aa, Homo Sapiens
VKPNECSEC

SEQ ID NO: 1396913 - protein, 9 aa, Homo Sapiens
LCRAHPMLK

SEQ ID NO: 1396914 - protein, 9 aa, Homo Sapiens
ALVFGLLLL

SEQ ID NO: 1396915 - protein, 9 aa, Homo Sapiens
TGGSTGDVD

SEQ ID NO: 1396916 - protein, 9 aa, Homo Sapiens
PGPPTLGQR

SEQ ID NO: 1396917 - protein, 9 aa, Homo Sapiens
RVPRFSSPS

SEQ ID NO: 1396918 - protein, 9 aa, Homo Sapiens
PAPAKLGSA

SEQ ID NO: 1396919 - protein, 9 aa, Homo Sapiens
KFSGVTSVW

SEQ ID NO: 1396920 - protein, 9 aa, Homo Sapiens
LAQRLLEVI

SEQ ID NO: 1396921 - protein, 9 aa, Homo Sapiens
PAKKGLPVG

SEQ ID NO: 1396922 - protein, 9 aa, Homo Sapiens
ELLKTLNMI

SEQ ID NO: 1396923 - protein, 9 aa, Homo Sapiens
NHPAEEVIL

SEQ ID NO: 1396924 - protein, 9 aa, Homo Sapiens
QQQPHHLPQ

SEQ ID NO: 1396925 - protein, 9 aa, Homo Sapiens
SSVLATGLH

SEQ ID NO: 1396926 - protein, 9 aa, Homo Sapiens
ECCCTSDVG

SEQ ID NO: 1396927 - protein, 9 aa, Homo Sapiens
ILALHSEEN

SEQ ID NO: 1396928 - protein, 9 aa, Homo Sapiens
IARRERPSN

SEQ ID NO: 1396929 - protein, 9 aa, Homo Sapiens
ATNPSMRAV

SEQ ID NO: 1396930 - protein, 9 aa, Homo Sapiens
PAGRSGVLT

SEQ ID NO: 1396931 - protein, 9 aa, Homo Sapiens
PRKAHPCPL

SEQ ID NO: 1396932 - protein, 9 aa, Homo Sapiens
FWRWSPCSA

SEQ ID NO: 1396933 - protein, 9 aa, Homo Sapiens
SRQVRVTVL

SEQ ID NO: 1396934 - protein, 9 aa, Homo Sapiens
GCGQHPGDG

SEQ ID NO: 1396935 - protein, 9 aa, Homo Sapiens
SCRTEMQLW

SEQ ID NO: 1396936 - protein, 9 aa, Homo Sapiens
GRASRKTWQ

SEQ ID NO: 1396937 - protein, 9 aa, Homo Sapiens
DANPSSHRV

SEQ ID NO: 1396938 - protein, 9 aa, Homo Sapiens
SGIRPGVAY

SEQ ID NO: 1396939 - protein, 9 aa, Homo Sapiens
PVQTLARSL

SEQ ID NO: 1396940 - protein, 9 aa, Homo Sapiens
GWPCWLLQF

SEQ ID NO: 1396941 - protein, 9 aa, Homo Sapiens
SPPAWDERL

SEQ ID NO: 1396942 - protein, 9 aa, Homo Sapiens
VQPEVTQVP

SEQ ID NO: 1396943 - protein, 9 aa, Homo Sapiens
VAIVVKFFL

SEQ ID NO: 1396944 - protein, 9 aa, Homo Sapiens
VLSQKLCNS

SEQ ID NO: 1396945 - protein, 9 aa, Homo Sapiens
RSARRWTAP

SEQ ID NO: 1396946 - protein, 9 aa, Homo Sapiens
RCSWISSQT

SEQ ID NO: 1396947 - protein, 9 aa, Homo Sapiens
TMVSSYRDR

SEQ ID NO: 1396948 - protein, 9 aa, Homo Sapiens
IPAPVPVLS

SEQ ID NO: 1396949 - protein, 9 aa, Homo Sapiens
LYGKKLVKI

SEQ ID NO: 1396950 - protein, 9 aa, Homo Sapiens
GLFLLVALS

SEQ ID NO: 1396951 - protein, 9 aa, Homo Sapiens
TGSLFKSRK

SEQ ID NO: 1396952 - protein, 9 aa, Homo Sapiens
ITIHNSVKN

SEQ ID NO: 1396953 - protein, 9 aa, Homo Sapiens
ASPRSNVAI

SEQ ID NO: 1396954 - protein, 9 aa, Homo Sapiens
ARGPTPPRS

SEQ ID NO: 1396955 - protein, 9 aa, Homo Sapiens
VASGNGCPD

SEQ ID NO: 1396956 - protein, 9 aa, Homo Sapiens
MQKCIHLVQ

SEQ ID NO: 1396957 - protein, 9 aa, Homo Sapiens
LVALVFIKY

SEQ ID NO: 1396958 - protein, 9 aa, Homo Sapiens
SAQPTAIPS

SEQ ID NO: 1396959 - protein, 9 aa, Homo Sapiens
LFGTSYPHS

SEQ ID NO: 1396960 - protein, 9 aa, Homo Sapiens
AWEPTWLER

SEQ ID NO: 1396961 - protein, 9 aa, Homo Sapiens
CGPARSARR

SEQ ID NO: 1396962 - protein, 9 aa, Homo Sapiens
DSATDSEDE

SEQ ID NO: 1396963 - protein, 9 aa, Homo Sapiens
EEEQKKTHE

SEQ ID NO: 1396964 - protein, 9 aa, Homo Sapiens
GERAAQCPL

SEQ ID NO: 1396965 - protein, 9 aa, Homo Sapiens
PPPTCPLGS

SEQ ID NO: 1396966 - protein, 9 aa, Homo Sapiens
ASMYTQMPN

SEQ ID NO: 1396967 - protein, 9 aa, Homo Sapiens
SWQLDANPS

SEQ ID NO: 1396968 - protein, 9 aa, Homo Sapiens
LRVILEVLQ

SEQ ID NO: 1396969 - protein, 9 aa, Homo Sapiens
DIPAKKGLP

SEQ ID NO: 1396970 - protein, 9 aa, Homo Sapiens
KPEMGLPPL

SEQ ID NO: 1396971 - protein, 9 aa, Homo Sapiens
ATVSQDHTV

SEQ ID NO: 1396972 - protein, 9 aa, Homo Sapiens
AERVLAYIQ

SEQ ID NO: 1396973 - protein, 9 aa, Homo Sapiens
LHVRRGGCP

SEQ ID NO: 1396974 - protein, 9 aa, Homo Sapiens
IELRKKIEE

SEQ ID NO: 1396975 - protein, 9 aa, Homo Sapiens
NPEWLVCLY

SEQ ID NO: 1396976 - protein, 9 aa, Homo Sapiens
SGEKISSWQ

SEQ ID NO: 1396977 - protein, 9 aa, Homo Sapiens
GLSAQLAGR

SEQ ID NO: 1396978 - protein, 9 aa, Homo Sapiens
GVVQNEPAQ

SEQ ID NO: 1396979 - protein, 9 aa, Homo Sapiens
KQTCTLFSW

SEQ ID NO: 1396980 - protein, 9 aa, Homo Sapiens
APPPSTAAT

SEQ ID NO: 1396981 - protein, 9 aa, Homo Sapiens
TPYCISIAR

SEQ ID NO: 1396982 - protein, 9 aa, Homo Sapiens
LHQNLVYLA

SEQ ID NO: 1396983 - protein, 9 aa, Homo Sapiens
AWTCPRKAH

SEQ ID NO: 1396984 - protein, 9 aa, Homo Sapiens
KVVEEEKLL

SEQ ID NO: 1396985 - protein, 9 aa, Homo Sapiens
APPPELTVV

SEQ ID NO: 1396986 - protein, 9 aa, Homo Sapiens
GPPDRDPML

SEQ ID NO: 1396987 - protein, 9 aa, Homo Sapiens
LKEMDNTGQ

SEQ ID NO: 1396988 - protein, 9 aa, Homo Sapiens
NLSLSLVDN

SEQ ID NO: 1396989 - protein, 9 aa, Homo Sapiens
CGYSGSGSG

SEQ ID NO: 1396990 - protein, 9 aa, Homo Sapiens
PSQPPTLPW

SEQ ID NO: 1396991 - protein, 9 aa, Homo Sapiens
VSGIRPGVA

SEQ ID NO: 1396992 - protein, 9 aa, Homo Sapiens
PLPNKPPLR

SEQ ID NO: 1396993 - protein, 9 aa, Homo Sapiens
FVLPLVVLC

SEQ ID NO: 1396994 - protein, 9 aa, Homo Sapiens
GLEQDLQHP

SEQ ID NO: 1396995 - protein, 9 aa, Homo Sapiens
SQLPWPAST

SEQ ID NO: 1396996 - protein, 9 aa, Homo Sapiens
AGAQANLEH

SEQ ID NO: 1396997 - protein, 9 aa, Homo Sapiens
AFPLPRASL

SEQ ID NO: 1396998 - protein, 9 aa, Homo Sapiens
KGQHFYWHC

SEQ ID NO: 1396999 - protein, 9 aa, Homo Sapiens
IQEDILSLL

SEQ ID NO: 1397000 - protein, 9 aa, Homo Sapiens
KNLPVQPVT

SEQ ID NO: 1397001 - protein, 9 aa, Homo Sapiens
VQAVQTMNR

SEQ ID NO: 1397002 - protein, 9 aa, Homo Sapiens
LTWLEPCTP

SEQ ID NO: 1397003 - protein, 9 aa, Homo Sapiens
PSRHVGGKA

SEQ ID NO: 1397004 - protein, 9 aa, Homo Sapiens
ILGSTGCSL

SEQ ID NO: 1397005 - protein, 9 aa, Homo Sapiens
NARRTAGST

SEQ ID NO: 1397006 - protein, 9 aa, Homo Sapiens
PSAFNNLKN

SEQ ID NO: 1397007 - protein, 9 aa, Homo Sapiens
FLTEDKKNG

SEQ ID NO: 1397008 - protein, 9 aa, Homo Sapiens
QSLFFHFPH

SEQ ID NO: 1397009 - protein, 9 aa, Homo Sapiens
HVAVICDSC

SEQ ID NO: 1397010 - protein, 9 aa, Homo Sapiens
ISLADYPAV

SEQ ID NO: 1397011 - protein, 9 aa, Homo Sapiens
PGAHSSHQA

SEQ ID NO: 1397012 - protein, 9 aa, Homo Sapiens
PKFTSLATA

SEQ ID NO: 1397013 - protein, 9 aa, Homo Sapiens
ERAAQCPLL

SEQ ID NO: 1397014 - protein, 9 aa, Homo Sapiens
RDNHLEIWS

SEQ ID NO: 1397015 - protein, 9 aa, Homo Sapiens
VPDLPPPHL

SEQ ID NO: 1397016 - protein, 9 aa, Homo Sapiens
QREHYWEEK

SEQ ID NO: 1397017 - protein, 9 aa, Homo Sapiens
WRRIGATTP

SEQ ID NO: 1397018 - protein, 9 aa, Homo Sapiens
NLIDVYGNT

SEQ ID NO: 1397019 - protein, 9 aa, Homo Sapiens
CGYIPSSLA

SEQ ID NO: 1397020 - protein, 9 aa, Homo Sapiens
ICEAVPGAK

SEQ ID NO: 1397021 - protein, 9 aa, Homo Sapiens
VDAGRYECV

SEQ ID NO: 1397022 - protein, 9 aa, Homo Sapiens
LLLGVCGHL

SEQ ID NO: 1397023 - protein, 9 aa, Homo Sapiens
SQVQLSEDE

SEQ ID NO: 1397024 - protein, 9 aa, Homo Sapiens
ARPSESSQS

SEQ ID NO: 1397025 - protein, 9 aa, Homo Sapiens
KRQELEKSN

SEQ ID NO: 1397026 - protein, 9 aa, Homo Sapiens
ILSSTLWNF

SEQ ID NO: 1397027 - protein, 9 aa, Homo Sapiens
GESSWLPEF

SEQ ID NO: 1397028 - protein, 9 aa, Homo Sapiens
DALEYDESV

SEQ ID NO: 1397029 - protein, 9 aa, Homo Sapiens
VRPVEDLSV

SEQ ID NO: 1397030 - protein, 9 aa, Homo Sapiens
LSDPGVCIF

SEQ ID NO: 1397031 - protein, 9 aa, Homo Sapiens
TSQSLRCTP

SEQ ID NO: 1397032 - protein, 9 aa, Homo Sapiens
VLGPSVTCG

SEQ ID NO: 1397033 - protein, 9 aa, Homo Sapiens
FLTCSFKEH

SEQ ID NO: 1397034 - protein, 9 aa, Homo Sapiens
HWNKVLCFE

SEQ ID NO: 1397035 - protein, 9 aa, Homo Sapiens
TSAPNGTTG

SEQ ID NO: 1397036 - protein, 9 aa, Homo Sapiens
NHRVKHKKE

SEQ ID NO: 1397037 - protein, 9 aa, Homo Sapiens
HTKLEEALS

SEQ ID NO: 1397038 - protein, 9 aa, Homo Sapiens
FVQQPEFHA

SEQ ID NO: 1397039 - protein, 9 aa, Homo Sapiens
ERQEARLQA

SEQ ID NO: 1397040 - protein, 9 aa, Homo Sapiens
SDEEVCGTG

SEQ ID NO: 1397041 - protein, 9 aa, Homo Sapiens
SPSQGILGS

SEQ ID NO: 1397042 - protein, 9 aa, Homo Sapiens
TMAAAPHTR

SEQ ID NO: 1397043 - protein, 9 aa, Homo Sapiens
CSTLKVATD

SEQ ID NO: 1397044 - protein, 9 aa, Homo Sapiens
PYRCRECDK

SEQ ID NO: 1397045 - protein, 9 aa, Homo Sapiens
LFKCYDAQL

SEQ ID NO: 1397046 - protein, 9 aa, Homo Sapiens
RRDSWPTRR

SEQ ID NO: 1397047 - protein, 9 aa, Homo Sapiens
EEEKVLQLT

SEQ ID NO: 1397048 - protein, 9 aa, Homo Sapiens
SKSEKLDPQ

SEQ ID NO: 1397049 - protein, 9 aa, Homo Sapiens
FYSRDTKLP

SEQ ID NO: 1397050 - protein, 9 aa, Homo Sapiens
MRARLQSQR

SEQ ID NO: 1397051 - protein, 9 aa, Homo Sapiens
PKPKAQTMN

SEQ ID NO: 1397052 - protein, 9 aa, Homo Sapiens
PAGDPGCQM

SEQ ID NO: 1397053 - protein, 9 aa, Homo Sapiens
WNKVLCFEL

SEQ ID NO: 1397054 - protein, 9 aa, Homo Sapiens
KKIEEKDPK

SEQ ID NO: 1397055 - protein, 9 aa, Homo Sapiens
CMVFYSRDT

SEQ ID NO: 1397056 - protein, 9 aa, Homo Sapiens
DENAVLIRV

SEQ ID NO: 1397057 - protein, 9 aa, Homo Sapiens
QHEDCCLRL

SEQ ID NO: 1397058 - protein, 9 aa, Homo Sapiens
KSFNYKSII

SEQ ID NO: 1397059 - protein, 9 aa, Homo Sapiens
IAALYEMPV

SEQ ID NO: 1397060 - protein, 9 aa, Homo Sapiens
DAGFLSRPA

SEQ ID NO: 1397061 - protein, 9 aa, Homo Sapiens
DYPFGPVEN

SEQ ID NO: 1397062 - protein, 9 aa, Homo Sapiens
LTLLLTSTP

SEQ ID NO: 1397063 - protein, 9 aa, Homo Sapiens
QLFILCLCT

SEQ ID NO: 1397064 - protein, 9 aa, Homo Sapiens
LSSSSTILF

SEQ ID NO: 1397065 - protein, 9 aa, Homo Sapiens
DINLIDVYG

SEQ ID NO: 1397066 - protein, 9 aa, Homo Sapiens
RGLPRAWGR

SEQ ID NO: 1397067 - protein, 9 aa, Homo Sapiens
LQTLLENGT

SEQ ID NO: 1397068 - protein, 9 aa, Homo Sapiens
LNCCRDVVL

SEQ ID NO: 1397069 - protein, 9 aa, Homo Sapiens
SLVIFVQNS

SEQ ID NO: 1397070 - protein, 9 aa, Homo Sapiens
QPSDVGSRP

SEQ ID NO: 1397071 - protein, 9 aa, Homo Sapiens
AKKGLPVGF

SEQ ID NO: 1397072 - protein, 9 aa, Homo Sapiens
DTYSGPPPR

SEQ ID NO: 1397073 - protein, 9 aa, Homo Sapiens
MVSSYRDRF

SEQ ID NO: 1397074 - protein, 9 aa, Homo Sapiens
AYGRLWRPT

SEQ ID NO: 1397075 - protein, 9 aa, Homo Sapiens
PQQRFCGRE

SEQ ID NO: 1397076 - protein, 9 aa, Homo Sapiens
AFSVTTWAS

SEQ ID NO: 1397077 - protein, 9 aa, Homo Sapiens
GSQDYPDSQ

SEQ ID NO: 1397078 - protein, 9 aa, Homo Sapiens
RTVAHQITL

SEQ ID NO: 1397079 - protein, 9 aa, Homo Sapiens
KKIKIGKKH

SEQ ID NO: 1397080 - protein, 9 aa, Homo Sapiens
APCPGTLSF

SEQ ID NO: 1397081 - protein, 9 aa, Homo Sapiens
QQKTPNFSA

SEQ ID NO: 1397082 - protein, 9 aa, Homo Sapiens
PPQEEEEED

SEQ ID NO: 1397083 - protein, 9 aa, Homo Sapiens
ETQSLAAET

SEQ ID NO: 1397084 - protein, 9 aa, Homo Sapiens
ELRKKIEEA

SEQ ID NO: 1397085 - protein, 9 aa, Homo Sapiens
LHYNVLMSP

SEQ ID NO: 1397086 - protein, 9 aa, Homo Sapiens
HRDRHFGWT

SEQ ID NO: 1397087 - protein, 9 aa, Homo Sapiens
PNVAFELDH

SEQ ID NO: 1397088 - protein, 9 aa, Homo Sapiens
PPPTKKKGA

SEQ ID NO: 1397089 - protein, 9 aa, Homo Sapiens
PEEILVRIG

SEQ ID NO: 1397090 - protein, 9 aa, Homo Sapiens
NPTWRRTGA

SEQ ID NO: 1397091 - protein, 9 aa, Homo Sapiens
YPEEDASDV

SEQ ID NO: 1397092 - protein, 9 aa, Homo Sapiens
TCLFCGNIF

SEQ ID NO: 1397093 - protein, 9 aa, Homo Sapiens
REKKNQKRN

SEQ ID NO: 1397094 - protein, 9 aa, Homo Sapiens
IFETLRIDV

SEQ ID NO: 1397095 - protein, 9 aa, Homo Sapiens
PLLTWLEPC

SEQ ID NO: 1397096 - protein, 9 aa, Homo Sapiens
PPGDCPRTM

SEQ ID NO: 1397097 - protein, 9 aa, Homo Sapiens
AAAAILRVI

SEQ ID NO: 1397098 - protein, 9 aa, Homo Sapiens
LAPGLITIG

SEQ ID NO: 1397099 - protein, 9 aa, Homo Sapiens
LKTLNMIQV

SEQ ID NO: 1397100 - protein, 9 aa, Homo Sapiens
SCSNIFLNF

SEQ ID NO: 1397101 - protein, 9 aa, Homo Sapiens
VAPSDKPPN

SEQ ID NO: 1397102 - protein, 9 aa, Homo Sapiens
TAWEPTWLE

SEQ ID NO: 1397103 - protein, 9 aa, Homo Sapiens
IVLLNSTDS

SEQ ID NO: 1397104 - protein, 9 aa, Homo Sapiens
CQEVRISPM

SEQ ID NO: 1397105 - protein, 9 aa, Homo Sapiens
VMIMGVKME

SEQ ID NO: 1397106 - protein, 9 aa, Homo Sapiens
LLTEYSYPL

SEQ ID NO: 1397107 - protein, 9 aa, Homo Sapiens
HLPNGLLGA

SEQ ID NO: 1397108 - protein, 9 aa, Homo Sapiens
SLFSVMSLV

SEQ ID NO: 1397109 - protein, 9 aa, Homo Sapiens
SLHQELYVE

SEQ ID NO: 1397110 - protein, 9 aa, Homo Sapiens
PVGRSFFST

SEQ ID NO: 1397111 - protein, 9 aa, Homo Sapiens
TSHHLVSMK

SEQ ID NO: 1397112 - protein, 9 aa, Homo Sapiens
QLATVSQDH

SEQ ID NO: 1397113 - protein, 9 aa, Homo Sapiens
PVLERRGSL

SEQ ID NO: 1397114 - protein, 9 aa, Homo Sapiens
PFRDLTQLA

SEQ ID NO: 1397115 - protein, 9 aa, Homo Sapiens
LSGPPPSPS

SEQ ID NO: 1397116 - protein, 9 aa, Homo Sapiens
CCTSDVGWG

SEQ ID NO: 1397117 - protein, 9 aa, Homo Sapiens
WRTKEQSRL

SEQ ID NO: 1397118 - protein, 9 aa, Homo Sapiens
DRNLGSPLM

SEQ ID NO: 1397119 - protein, 9 aa, Homo Sapiens
RQDLSSPSD

SEQ ID NO: 1397120 - protein, 9 aa, Homo Sapiens
ANLCKNELE

SEQ ID NO: 1397121 - protein, 9 aa, Homo Sapiens
EGSQDYPDS

SEQ ID NO: 1397122 - protein, 9 aa, Homo Sapiens
LEGCISVKD

SEQ ID NO: 1397123 - protein, 9 aa, Homo Sapiens
AGLSAQLAG

SEQ ID NO: 1397124 - protein, 9 aa, Homo Sapiens
NCKMIYLAH

SEQ ID NO: 1397125 - protein, 9 aa, Homo Sapiens
PALRPPAAV

SEQ ID NO: 1397126 - protein, 9 aa, Homo Sapiens
KTPNFSALL

SEQ ID NO: 1397127 - protein, 9 aa, Homo Sapiens
PTAIRQTLY

SEQ ID NO: 1397128 - protein, 9 aa, Homo Sapiens
DLDGMLTVI

SEQ ID NO: 1397129 - protein, 9 aa, Homo Sapiens
SECMTAHSG

SEQ ID NO: 1397130 - protein, 9 aa, Homo Sapiens
WNFCLLPQQ

SEQ ID NO: 1397131 - protein, 9 aa, Homo Sapiens
ALTRIACKV

SEQ ID NO: 1397132 - protein, 9 aa, Homo Sapiens
RMFCSGNAV

SEQ ID NO: 1397133 - protein, 9 aa, Homo Sapiens
GKDSATDSE

SEQ ID NO: 1397134 - protein, 9 aa, Homo Sapiens
ETPRLGKKK

SEQ ID NO: 1397135 - protein, 9 aa, Homo Sapiens
KKVSTRKNG

SEQ ID NO: 1397136 - protein, 9 aa, Homo Sapiens
DFIASGSEN

SEQ ID NO: 1397137 - protein, 9 aa, Homo Sapiens
GYQSIKRKF

SEQ ID NO: 1397138 - protein, 9 aa, Homo Sapiens
TWNPSQISG

SEQ ID NO: 1397139 - protein, 9 aa, Homo Sapiens
QPALRPPAA

SEQ ID NO: 1397140 - protein, 9 aa, Homo Sapiens
TVQQHGRRL

SEQ ID NO: 1397141 - protein, 9 aa, Homo Sapiens
LCSKTVDYH

SEQ ID NO: 1397142 - protein, 9 aa, Homo Sapiens
TIYSPDGVR

SEQ ID NO: 1397143 - protein, 9 aa, Homo Sapiens
NQNNWLCTS

SEQ ID NO: 1397144 - protein, 9 aa, Homo Sapiens
HSPPRALVL

SEQ ID NO: 1397145 - protein, 9 aa, Homo Sapiens
LLCLMVIVI

SEQ ID NO: 1397146 - protein, 9 aa, Homo Sapiens
YIIMVLFAD

SEQ ID NO: 1397147 - protein, 9 aa, Homo Sapiens
PRPPPLVRC

SEQ ID NO: 1397148 - protein, 9 aa, Homo Sapiens
QESGHKKVT

SEQ ID NO: 1397149 - protein, 9 aa, Homo Sapiens
MIMGVKMEA

SEQ ID NO: 1397150 - protein, 9 aa, Homo Sapiens
TNRVCSLQF

SEQ ID NO: 1397151 - protein, 9 aa, Homo Sapiens
HFCVGSLIN

SEQ ID NO: 1397152 - protein, 9 aa, Homo Sapiens
INSQVCPEQ

SEQ ID NO: 1397153 - protein, 9 aa, Homo Sapiens
QEVRISPMS

SEQ ID NO: 1397154 - protein, 9 aa, Homo Sapiens
WKRETIVLQ

SEQ ID NO: 1397155 - protein, 9 aa, Homo Sapiens
WLSHRLRLR

SEQ ID NO: 1397156 - protein, 9 aa, Homo Sapiens
LHQELYVED

SEQ ID NO: 1397157 - protein, 9 aa, Homo Sapiens
TEKPVWSLL

SEQ ID NO: 1397158 - protein, 9 aa, Homo Sapiens
LIDVYGNTA

SEQ ID NO: 1397159 - protein, 9 aa, Homo Sapiens
FEELLVPKR

SEQ ID NO: 1397160 - protein, 9 aa, Homo Sapiens
FSAPACLLG

SEQ ID NO: 1397161 - protein, 9 aa, Homo Sapiens
MHLRGDINK

SEQ ID NO: 1397162 - protein, 9 aa, Homo Sapiens
EASGGAWKS

SEQ ID NO: 1397163 - protein, 9 aa, Homo Sapiens
KKCRSYWTS

SEQ ID NO: 1397164 - protein, 9 aa, Homo Sapiens
LPERKCFPG

SEQ ID NO: 1397165 - protein, 9 aa, Homo Sapiens
SQLEFKRIS

SEQ ID NO: 1397166 - protein, 9 aa, Homo Sapiens
SQDTALAFR

SEQ ID NO: 1397167 - protein, 9 aa, Homo Sapiens
PAWCCSWHL

SEQ ID NO: 1397168 - protein, 9 aa, Homo Sapiens
RREELLKKC

SEQ ID NO: 1397169 - protein, 9 aa, Homo Sapiens
IRAGPNKIL

SEQ ID NO: 1397170 - protein, 9 aa, Homo Sapiens
GAERVLAYI

SEQ ID NO: 1397171 - protein, 9 aa, Homo Sapiens
TASGLKNIP

SEQ ID NO: 1397172 - protein, 9 aa, Homo Sapiens
RTRIDRCRR

SEQ ID NO: 1397173 - protein, 9 aa, Homo Sapiens
SWQVLFMNI

SEQ ID NO: 1397174 - protein, 9 aa, Homo Sapiens
TSCPPLLEA

SEQ ID NO: 1397175 - protein, 9 aa, Homo Sapiens
MDGSDEEVC

SEQ ID NO: 1397176 - protein, 9 aa, Homo Sapiens
TLKVATDLQ

SEQ ID NO: 1397177 - protein, 9 aa, Homo Sapiens
KEHVNPEYF

SEQ ID NO: 1397178 - protein, 9 aa, Homo Sapiens
LELRQGLTF

SEQ ID NO: 1397179 - protein, 9 aa, Homo Sapiens
QNSGWLYCM

SEQ ID NO: 1397180 - protein, 9 aa, Homo Sapiens
GLPGPTVPD

SEQ ID NO: 1397181 - protein, 9 aa, Homo Sapiens
RPSESSQST

SEQ ID NO: 1397182 - protein, 9 aa, Homo Sapiens
VTSAPNGTT

SEQ ID NO: 1397183 - protein, 9 aa, Homo Sapiens
LKSGCVFII

SEQ ID NO: 1397184 - protein, 9 aa, Homo Sapiens
VRGTSPSQG

SEQ ID NO: 1397185 - protein, 9 aa, Homo Sapiens
LPKSSPLPS

SEQ ID NO: 1397186 - protein, 9 aa, Homo Sapiens
RAENLLHNH

SEQ ID NO: 1397187 - protein, 9 aa, Homo Sapiens
GGPATFHAG

SEQ ID NO: 1397188 - protein, 9 aa, Homo Sapiens
SSPAPPPEL

SEQ ID NO: 1397189 - protein, 9 aa, Homo Sapiens
RKNGGGLKR

SEQ ID NO: 1397190 - protein, 9 aa, Homo Sapiens
FATRGWRAQ

SEQ ID NO: 1397191 - protein, 9 aa, Homo Sapiens
RALPSILLT

SEQ ID NO: 1397192 - protein, 9 aa, Homo Sapiens
QLPWPASTC

SEQ ID NO: 1397193 - protein, 9 aa, Homo Sapiens
CAARSQLPW

SEQ ID NO: 1397194 - protein, 9 aa, Homo Sapiens
FGSPSGGAE

SEQ ID NO: 1397195 - protein, 9 aa, Homo Sapiens
LEYLTVEIL

SEQ ID NO: 1397196 - protein, 9 aa, Homo Sapiens
AVITSNTIV

SEQ ID NO: 1397197 - protein, 9 aa, Homo Sapiens
PGCQMCAAC

SEQ ID NO: 1397198 - protein, 9 aa, Homo Sapiens
HRTSQNHSK

SEQ ID NO: 1397199 - protein, 9 aa, Homo Sapiens
QAVWQDPLL

SEQ ID NO: 1397200 - protein, 9 aa, Homo Sapiens
CGRVEGLLY

SEQ ID NO: 1397201 - protein, 9 aa, Homo Sapiens
AFLPERKCF

SEQ ID NO: 1397202 - protein, 9 aa, Homo Sapiens
LHPASGRAS

SEQ ID NO: 1397203 - protein, 9 aa, Homo Sapiens
YPLPKFTSL

SEQ ID NO: 1397204 - protein, 9 aa, Homo Sapiens
AFCEPLWTI

SEQ ID NO: 1397205 - protein, 9 aa, Homo Sapiens
HLRGDINKL

SEQ ID NO: 1397206 - protein, 9 aa, Homo Sapiens
RGAPRHPHR

SEQ ID NO: 1397207 - protein, 9 aa, Homo Sapiens
PGWFFGEQV

SEQ ID NO: 1397208 - protein, 9 aa, Homo Sapiens
AKKKCHSSE

SEQ ID NO: 1397209 - protein, 9 aa, Homo Sapiens
YVMKTGSDM

SEQ ID NO: 1397210 - protein, 9 aa, Homo Sapiens
LTWMRPKKC

SEQ ID NO: 1397211 - protein, 9 aa, Homo Sapiens
PGAPLPKCR

SEQ ID NO: 1397212 - protein, 9 aa, Homo Sapiens
DGLMAHAFP

SEQ ID NO: 1397213 - protein, 9 aa, Homo Sapiens
ELPPASPLK

SEQ ID NO: 1397214 - protein, 9 aa, Homo Sapiens
ALQKQVETQ

SEQ ID NO: 1397215 - protein, 9 aa, Homo Sapiens
LHEVVKMHV

SEQ ID NO: 1397216 - protein, 9 aa, Homo Sapiens
CFPGNQHPL

SEQ ID NO: 1397217 - protein, 9 aa, Homo Sapiens
ITCHLRTRI

SEQ ID NO: 1397218 - protein, 9 aa, Homo Sapiens
PGGHAQPEA

SEQ ID NO: 1397219 - protein, 9 aa, Homo Sapiens
PWLLRYPSL

SEQ ID NO: 1397220 - protein, 9 aa, Homo Sapiens
PDSQLPIPE

SEQ ID NO: 1397221 - protein, 9 aa, Homo Sapiens
YCMKVLVLV

SEQ ID NO: 1397222 - protein, 9 aa, Homo Sapiens
LPQHALVCL

SEQ ID NO: 1397223 - protein, 9 aa, Homo Sapiens
TSLATAWEP

SEQ ID NO: 1397224 - protein, 9 aa, Homo Sapiens
RVLVAHYVL

SEQ ID NO: 1397225 - protein, 9 aa, Homo Sapiens
AAAAAPTGA

SEQ ID NO: 1397226 - protein, 9 aa, Homo Sapiens
AQPQQQQQQ

SEQ ID NO: 1397227 - protein, 9 aa, Homo Sapiens
SLRVGLRHK

SEQ ID NO: 1397228 - protein, 9 aa, Homo Sapiens
LGLKEMDNT

SEQ ID NO: 1397229 - protein, 9 aa, Homo Sapiens
IWRRIGATT

SEQ ID NO: 1397230 - protein, 9 aa, Homo Sapiens
GWWGQKTKV

SEQ ID NO: 1397231 - protein, 9 aa, Homo Sapiens
KTLNMIQVL

SEQ ID NO: 1397232 - protein, 9 aa, Homo Sapiens
AHSSGLTDD

SEQ ID NO: 1397233 - protein, 9 aa, Homo Sapiens
ARSLGICVV

SEQ ID NO: 1397234 - protein, 9 aa, Homo Sapiens
PQGHQGPWH

SEQ ID NO: 1397235 - protein, 9 aa, Homo Sapiens
DIVPHLLLM

SEQ ID NO: 1397236 - protein, 9 aa, Homo Sapiens
SYRSLLCPG

SEQ ID NO: 1397237 - protein, 9 aa, Homo Sapiens
ISSARQLSR

SEQ ID NO: 1397238 - protein, 9 aa, Homo Sapiens
PEKERRPRK

SEQ ID NO: 1397239 - protein, 9 aa, Homo Sapiens
DPRHLVQLL

SEQ ID NO: 1397240 - protein, 9 aa, Homo Sapiens
EERRRECRI

SEQ ID NO: 1397241 - protein, 9 aa, Homo Sapiens
LVLCLALGS

SEQ ID NO: 1397242 - protein, 9 aa, Homo Sapiens
PTPTEPPLP

SEQ ID NO: 1397243 - protein, 9 aa, Homo Sapiens
AAVLEYLTV

SEQ ID NO: 1397244 - protein, 9 aa, Homo Sapiens
LHTSPPPGY

SEQ ID NO: 1397245 - protein, 9 aa, Homo Sapiens
PALRARGGT

SEQ ID NO: 1397246 - protein, 9 aa, Homo Sapiens
HVRRGGCPG

SEQ ID NO: 1397247 - protein, 9 aa, Homo Sapiens
PRMRGNLAL

SEQ ID NO: 1397248 - protein, 9 aa, Homo Sapiens
ICVVKDLSS

SEQ ID NO: 1397249 - protein, 9 aa, Homo Sapiens
LRSRLPGPP

SEQ ID NO: 1397250 - protein, 9 aa, Homo Sapiens
TTAAGASGW

SEQ ID NO: 1397251 - protein, 9 aa, Homo Sapiens
LGSEGCIPS

SEQ ID NO: 1397252 - protein, 9 aa, Homo Sapiens
SRCCPPGHP

SEQ ID NO: 1397253 - protein, 9 aa, Homo Sapiens
QNEPAQREP

SEQ ID NO: 1397254 - protein, 9 aa, Homo Sapiens
GPVRLLLGV

SEQ ID NO: 1397255 - protein, 9 aa, Homo Sapiens
LKAAIKRQK

SEQ ID NO: 1397256 - protein, 9 aa, Homo Sapiens
ELQDVIGKT

SEQ ID NO: 1397257 - protein, 9 aa, Homo Sapiens
ALLCYDRVF

SEQ ID NO: 1397258 - protein, 9 aa, Homo Sapiens
PSSCNPPAM

SEQ ID NO: 1397259 - protein, 9 aa, Homo Sapiens
PAPPPYSES

SEQ ID NO: 1397260 - protein, 9 aa, Homo Sapiens
AQTMNSFLV

SEQ ID NO: 1397261 - protein, 9 aa, Homo Sapiens
DDGAGAQAN

SEQ ID NO: 1397262 - protein, 9 aa, Homo Sapiens
YMEMVKNLR

SEQ ID NO: 1397263 - protein, 9 aa, Homo Sapiens
VCPEQFAHG

SEQ ID NO: 1397264 - protein, 9 aa, Homo Sapiens
WPGDSDVSL

SEQ ID NO: 1397265 - protein, 9 aa, Homo Sapiens
NNSSESHIS

SEQ ID NO: 1397266 - protein, 9 aa, Homo Sapiens
QGSLFVENS

SEQ ID NO: 1397267 - protein, 9 aa, Homo Sapiens
DSWPTRRST

SEQ ID NO: 1397268 - protein, 9 aa, Homo Sapiens
SPPLQDGSL

SEQ ID NO: 1397269 - protein, 9 aa, Homo Sapiens
ACDACVGMI

SEQ ID NO: 1397270 - protein, 9 aa, Homo Sapiens
EERGRTQPS

SEQ ID NO: 1397271 - protein, 9 aa, Homo Sapiens
TEMQLWRQD

SEQ ID NO: 1397272 - protein, 9 aa, Homo Sapiens
YVNTVTLAP

SEQ ID NO: 1397273 - protein, 9 aa, Homo Sapiens
WGRLCVDAG

SEQ ID NO: 1397274 - protein, 9 aa, Homo Sapiens
ALAQAIAVQ

SEQ ID NO: 1397275 - protein, 9 aa, Homo Sapiens
PRSNVAIPA

SEQ ID NO: 1397276 - protein, 9 aa, Homo Sapiens
QGPRSCSEA

SEQ ID NO: 1397277 - protein, 9 aa, Homo Sapiens
VILPDDVCD

SEQ ID NO: 1397278 - protein, 9 aa, Homo Sapiens
PRTLEGCIS

SEQ ID NO: 1397279 - protein, 9 aa, Homo Sapiens
LCAYVAIFV

SEQ ID NO: 1397280 - protein, 9 aa, Homo Sapiens
TSSQDMIDH

SEQ ID NO: 1397281 - protein, 9 aa, Homo Sapiens
IREVHEWND

SEQ ID NO: 1397282 - protein, 9 aa, Homo Sapiens
EELLKKCSL

SEQ ID NO: 1397283 - protein, 9 aa, Homo Sapiens
WWRTRACTP

SEQ ID NO: 1397284 - protein, 9 aa, Homo Sapiens
GGEITDDLD

SEQ ID NO: 1397285 - protein, 9 aa, Homo Sapiens
LPPELPPAS

SEQ ID NO: 1397286 - protein, 9 aa, Homo Sapiens
SALVALVFI

SEQ ID NO: 1397287 - protein, 9 aa, Homo Sapiens
PGIRGALTT

SEQ ID NO: 1397288 - protein, 9 aa, Homo Sapiens
EVSLFTPRP

SEQ ID NO: 1397289 - protein, 9 aa, Homo Sapiens
NINECEHRN

SEQ ID NO: 1397290 - protein, 9 aa, Homo Sapiens
EVRISPMSH

SEQ ID NO: 1397291 - protein, 9 aa, Homo Sapiens
NQSVCSQGS

SEQ ID NO: 1397292 - protein, 9 aa, Homo Sapiens
RSFFSTPEG

SEQ ID NO: 1397293 - protein, 9 aa, Homo Sapiens
ECDKAFNHS

SEQ ID NO: 1397294 - protein, 9 aa, Homo Sapiens
EQAVGARKQ

SEQ ID NO: 1397295 - protein, 9 aa, Homo Sapiens
KSIIIVHQR

SEQ ID NO: 1397296 - protein, 9 aa, Homo Sapiens
GGWRGWWGN

SEQ ID NO: 1397297 - protein, 9 aa, Homo Sapiens
PPVTTSRCC

SEQ ID NO: 1397298 - protein, 9 aa, Homo Sapiens
PNFSALLCY

SEQ ID NO: 1397299 - protein, 9 aa, Homo Sapiens
DTYCHLYSL

SEQ ID NO: 1397300 - protein, 9 aa, Homo Sapiens
ACTALQNNF

SEQ ID NO: 1397301 - protein, 9 aa, Homo Sapiens
PRAAIWRRI

SEQ ID NO: 1397302 - protein, 9 aa, Homo Sapiens
PNECSECGK

SEQ ID NO: 1397303 - protein, 9 aa, Homo Sapiens
MEPTLQLLR

SEQ ID NO: 1397304 - protein, 9 aa, Homo Sapiens
GWRAQALLA

SEQ ID NO: 1397305 - protein, 9 aa, Homo Sapiens
LGDGKKMDL

SEQ ID NO: 1397306 - protein, 9 aa, Homo Sapiens
PATTRRASC

SEQ ID NO: 1397307 - protein, 9 aa, Homo Sapiens
CPLLDCRSF

SEQ ID NO: 1397308 - protein, 9 aa, Homo Sapiens
LPPQVPTSL

SEQ ID NO: 1397309 - protein, 9 aa, Homo Sapiens
HTNTSHIMQ

SEQ ID NO: 1397310 - protein, 9 aa, Homo Sapiens
ETYCACRAC

SEQ ID NO: 1397311 - protein, 9 aa, Homo Sapiens
GAPLPKCRV

SEQ ID NO: 1397312 - protein, 9 aa, Homo Sapiens
LSLDDMHTD

SEQ ID NO: 1397313 - protein, 9 aa, Homo Sapiens
CSKTVDYHR

SEQ ID NO: 1397314 - protein, 9 aa, Homo Sapiens
LGGRGRQIT

SEQ ID NO: 1397315 - protein, 9 aa, Homo Sapiens
HLVSMKSIS

SEQ ID NO: 1397316 - protein, 9 aa, Homo Sapiens
LILVTGQMW

SEQ ID NO: 1397317 - protein, 9 aa, Homo Sapiens
GSPISPVIY

SEQ ID NO: 1397318 - protein, 9 aa, Homo Sapiens
ARPPAEEEE

SEQ ID NO: 1397319 - protein, 9 aa, Homo Sapiens
ATRGWRAQA

SEQ ID NO: 1397320 - protein, 9 aa, Homo Sapiens
RDRHFGWTP

SEQ ID NO: 1397321 - protein, 9 aa, Homo Sapiens
SCTSLDAMV

SEQ ID NO: 1397322 - protein, 9 aa, Homo Sapiens
FPGNQHPLG

SEQ ID NO: 1397323 - protein, 9 aa, Homo Sapiens
CAYVAIFVM

SEQ ID NO: 1397324 - protein, 9 aa, Homo Sapiens
DTVSDNDAG

SEQ ID NO: 1397325 - protein, 9 aa, Homo Sapiens
VLLSRWTEA

SEQ ID NO: 1397326 - protein, 9 aa, Homo Sapiens
YVGGYFGHH

SEQ ID NO: 1397327 - protein, 9 aa, Homo Sapiens
LDDMHTDVI

SEQ ID NO: 1397328 - protein, 9 aa, Homo Sapiens
KYVTYRNIR

SEQ ID NO: 1397329 - protein, 9 aa, Homo Sapiens
TPVPTATAA

SEQ ID NO: 1397330 - protein, 9 aa, Homo Sapiens
TPTADPPAQ

SEQ ID NO: 1397331 - protein, 9 aa, Homo Sapiens
RPPVTTSRC

SEQ ID NO: 1397332 - protein, 9 aa, Homo Sapiens
SEFRKIFET

SEQ ID NO: 1397333 - protein, 9 aa, Homo Sapiens
FCVASGNGC

SEQ ID NO: 1397334 - protein, 9 aa, Homo Sapiens
INKITPPFN

SEQ ID NO: 1397335 - protein, 9 aa, Homo Sapiens
NFSCTWNPS

SEQ ID NO: 1397336 - protein, 9 aa, Homo Sapiens
FRPLEKCYE

SEQ ID NO: 1397337 - protein, 9 aa, Homo Sapiens
RVLKNPPEN

SEQ ID NO: 1397338 - protein, 9 aa, Homo Sapiens
EKPVWSLLN

SEQ ID NO: 1397339 - protein, 9 aa, Homo Sapiens
AASVFYTVA

SEQ ID NO: 1397340 - protein, 9 aa, Homo Sapiens
VVTVHLQTL

SEQ ID NO: 1397341 - protein, 9 aa, Homo Sapiens
SASSPQTPY

SEQ ID NO: 1397342 - protein, 9 aa, Homo Sapiens
ITEKSNMLE

SEQ ID NO: 1397343 - protein, 9 aa, Homo Sapiens
PNQNNWLCT

SEQ ID NO: 1397344 - protein, 9 aa, Homo Sapiens
SPRSNVAIP

SEQ ID NO: 1397345 - protein, 9 aa, Homo Sapiens
KYTDRALQA

SEQ ID NO: 1397346 - protein, 9 aa, Homo Sapiens
KMHVKQEEK

SEQ ID NO: 1397347 - protein, 9 aa, Homo Sapiens
SVMSLVIFV

SEQ ID NO: 1397348 - protein, 9 aa, Homo Sapiens
LLINSQVCP

SEQ ID NO: 1397349 - protein, 9 aa, Homo Sapiens
DTPALRTLT

SEQ ID NO: 1397350 - protein, 9 aa, Homo Sapiens
LTQLAVITS

SEQ ID NO: 1397351 - protein, 9 aa, Homo Sapiens
IMGVKMEAT

SEQ ID NO: 1397352 - protein, 9 aa, Homo Sapiens
LTEDKKNGI

SEQ ID NO: 1397353 - protein, 9 aa, Homo Sapiens
LSRARSVEQ

SEQ ID NO: 1397354 - protein, 9 aa, Homo Sapiens
NYKSIIIVH

SEQ ID NO: 1397355 - protein, 9 aa, Homo Sapiens
QILHQNLVY

SEQ ID NO: 1397356 - protein, 9 aa, Homo Sapiens
ATLSLFYTY

SEQ ID NO: 1397357 - protein, 9 aa, Homo Sapiens
RLYSGYLID

SEQ ID NO: 1397358 - protein, 9 aa, Homo Sapiens
LNKKKCRSY

SEQ ID NO: 1397359 - protein, 9 aa, Homo Sapiens
RMHLCQYEL

SEQ ID NO: 1397360 - protein, 9 aa, Homo Sapiens
RWKIPIGWA

SEQ ID NO: 1397361 - protein, 9 aa, Homo Sapiens
RPWCRESLG

SEQ ID NO: 1397362 - protein, 9 aa, Homo Sapiens
MHWRAWWQE

SEQ ID NO: 1397363 - protein, 9 aa, Homo Sapiens
ACAHYPRES

SEQ ID NO: 1397364 - protein, 9 aa, Homo Sapiens
SQTYMHPMK

SEQ ID NO: 1397365 - protein, 9 aa, Homo Sapiens
DFLRNFLIK

SEQ ID NO: 1397366 - protein, 9 aa, Homo Sapiens
DRKCYGHGV

SEQ ID NO: 1397367 - protein, 9 aa, Homo Sapiens
GLKEMDNTG

SEQ ID NO: 1397368 - protein, 9 aa, Homo Sapiens
ASVGWLQWR

SEQ ID NO: 1397369 - protein, 9 aa, Homo Sapiens
PSVLLSSVL

SEQ ID NO: 1397370 - protein, 9 aa, Homo Sapiens
FSGVTSVWA

SEQ ID NO: 1397371 - protein, 9 aa, Homo Sapiens
NLNFSVIVA

SEQ ID NO: 1397372 - protein, 9 aa, Homo Sapiens
ESSWLSRRT

SEQ ID NO: 1397373 - protein, 9 aa, Homo Sapiens
TGSRRNGSC

SEQ ID NO: 1397374 - protein, 9 aa, Homo Sapiens
QVKTYHGGG

SEQ ID NO: 1397375 - protein, 9 aa, Homo Sapiens
QPIIAALYE

SEQ ID NO: 1397376 - protein, 9 aa, Homo Sapiens
KCFPGNQHP

SEQ ID NO: 1397377 - protein, 9 aa, Homo Sapiens
ADYPAVPRY

SEQ ID NO: 1397378 - protein, 9 aa, Homo Sapiens
VMVARCKRE

SEQ ID NO: 1397379 - protein, 9 aa, Homo Sapiens
EGQFMYHHS

SEQ ID NO: 1397380 - protein, 9 aa, Homo Sapiens
EREHIHAKG

SEQ ID NO: 1397381 - protein, 9 aa, Homo Sapiens
SGNGCPDSG

SEQ ID NO: 1397382 - protein, 9 aa, Homo Sapiens
SHLSPLSTL

SEQ ID NO: 1397383 - protein, 9 aa, Homo Sapiens
QDHTVRIWD

SEQ ID NO: 1397384 - protein, 9 aa, Homo Sapiens
QTPITGILV

SEQ ID NO: 1397385 - protein, 9 aa, Homo Sapiens
KNGIWEVMP

SEQ ID NO: 1397386 - protein, 9 aa, Homo Sapiens
VDPGKASKA

SEQ ID NO: 1397387 - protein, 9 aa, Homo Sapiens
QDTALAFRV

SEQ ID NO: 1397388 - protein, 9 aa, Homo Sapiens
RYVCENCKP

SEQ ID NO: 1397389 - protein, 9 aa, Homo Sapiens
QHLWLSHRL

SEQ ID NO: 1397390 - protein, 9 aa, Homo Sapiens
PSATNPTWR

SEQ ID NO: 1397391 - protein, 9 aa, Homo Sapiens
QEDILSLLS

SEQ ID NO: 1397392 - protein, 9 aa, Homo Sapiens
PPSPSRRLR

SEQ ID NO: 1397393 - protein, 9 aa, Homo Sapiens
THAFGYGVG

SEQ ID NO: 1397394 - protein, 9 aa, Homo Sapiens
KRAVEKVKK

SEQ ID NO: 1397395 - protein, 9 aa, Homo Sapiens
DPHLLYTLG

SEQ ID NO: 1397396 - protein, 9 aa, Homo Sapiens
EVLFHVGSS

SEQ ID NO: 1397397 - protein, 9 aa, Homo Sapiens
TRGRSVRPP

SEQ ID NO: 1397398 - protein, 9 aa, Homo Sapiens
CFWTPHSPD

SEQ ID NO: 1397399 - protein, 9 aa, Homo Sapiens
QESSILSST

SEQ ID NO: 1397400 - protein, 9 aa, Homo Sapiens
ALGMPSMPS

SEQ ID NO: 1397401 - protein, 9 aa, Homo Sapiens
ESLGGWRGW

SEQ ID NO: 1397402 - protein, 9 aa, Homo Sapiens
SGHKKVTAV

SEQ ID NO: 1397403 - protein, 9 aa, Homo Sapiens
LRSSENSAS

SEQ ID NO: 1397404 - protein, 9 aa, Homo Sapiens
ERQREHYWE

SEQ ID NO: 1397405 - protein, 9 aa, Homo Sapiens
PGLPGPTVP

SEQ ID NO: 1397406 - protein, 9 aa, Homo Sapiens
PLPPNTKDR

SEQ ID NO: 1397407 - protein, 9 aa, Homo Sapiens
RPLEKCYEG

SEQ ID NO: 1397408 - protein, 9 aa, Homo Sapiens
RGSWMGARG

SEQ ID NO: 1397409 - protein, 9 aa, Homo Sapiens
CHIRAGPNK

SEQ ID NO: 1397410 - protein, 9 aa, Homo Sapiens
KKEKKKKKT

SEQ ID NO: 1397411 - protein, 9 aa, Homo Sapiens
YNICSIYNL

SEQ ID NO: 1397412 - protein, 9 aa, Homo Sapiens
QKSLQKICS

SEQ ID NO: 1397413 - protein, 9 aa, Homo Sapiens
NTVTLAPNV

SEQ ID NO: 1397414 - protein, 9 aa, Homo Sapiens
VGMIAECPG

SEQ ID NO: 1397415 - protein, 9 aa, Homo Sapiens
PEVPATAPV

SEQ ID NO: 1397416 - protein, 9 aa, Homo Sapiens
VLVAHYVLG

SEQ ID NO: 1397417 - protein, 9 aa, Homo Sapiens
QQALRFQGP

SEQ ID NO: 1397418 - protein, 9 aa, Homo Sapiens
PPTTTTSSP

SEQ ID NO: 1397419 - protein, 9 aa, Homo Sapiens
VFPLCPWLP

SEQ ID NO: 1397420 - protein, 9 aa, Homo Sapiens
TYISLILGA

SEQ ID NO: 1397421 - protein, 9 aa, Homo Sapiens
TLAEFVNIS

SEQ ID NO: 1397422 - protein, 9 aa, Homo Sapiens
YPWKEYKSD

SEQ ID NO: 1397423 - protein, 9 aa, Homo Sapiens
WFFSKRIKS

SEQ ID NO: 1397424 - protein, 9 aa, Homo Sapiens
IKIGKKHQR

SEQ ID NO: 1397425 - protein, 9 aa, Homo Sapiens
PTEPPLPTA

SEQ ID NO: 1397426 - protein, 9 aa, Homo Sapiens
PRTMAGPSA

SEQ ID NO: 1397427 - protein, 9 aa, Homo Sapiens
FRLYSRAVL

SEQ ID NO: 1397428 - protein, 9 aa, Homo Sapiens
ENEGASSPG

SEQ ID NO: 1397429 - protein, 9 aa, Homo Sapiens
LPRLHVRRG

SEQ ID NO: 1397430 - protein, 9 aa, Homo Sapiens
SANIEDISE

SEQ ID NO: 1397431 - protein, 9 aa, Homo Sapiens
TDVIHSVCW

SEQ ID NO: 1397432 - protein, 9 aa, Homo Sapiens
VVKMHVKQE

SEQ ID NO: 1397433 - protein, 9 aa, Homo Sapiens
KSRLRDPSL

SEQ ID NO: 1397434 - protein, 9 aa, Homo Sapiens
FQGPAPPPN

SEQ ID NO: 1397435 - protein, 9 aa, Homo Sapiens
PSSSAPTGA

SEQ ID NO: 1397436 - protein, 9 aa, Homo Sapiens
KHEKKSLRW

SEQ ID NO: 1397437 - protein, 9 aa, Homo Sapiens
ITREAISRI

SEQ ID NO: 1397438 - protein, 9 aa, Homo Sapiens
QLAGRRVWG

SEQ ID NO: 1397439 - protein, 9 aa, Homo Sapiens
LEYLKSPPS

SEQ ID NO: 1397440 - protein, 9 aa, Homo Sapiens
EYVQAGWPC

SEQ ID NO: 1397441 - protein, 9 aa, Homo Sapiens
GASTRASGP

SEQ ID NO: 1397442 - protein, 9 aa, Homo Sapiens
SSPTARATS

SEQ ID NO: 1397443 - protein, 9 aa, Homo Sapiens
EEQKKTHEK

SEQ ID NO: 1397444 - protein, 9 aa, Homo Sapiens
ESSRQTLQN

SEQ ID NO: 1397445 - protein, 9 aa, Homo Sapiens
GAPSAFDRN

SEQ ID NO: 1397446 - protein, 9 aa, Homo Sapiens
VQTLARSLV

SEQ ID NO: 1397447 - protein, 9 aa, Homo Sapiens
IDRCRRGFG

SEQ ID NO: 1397448 - protein, 9 aa, Homo Sapiens
TAASARSPT

SEQ ID NO: 1397449 - protein, 9 aa, Homo Sapiens
SLVGLQILH

SEQ ID NO: 1397450 - protein, 9 aa, Homo Sapiens
CKCRRPRGG

SEQ ID NO: 1397451 - protein, 9 aa, Homo Sapiens
DPASRLSTS

SEQ ID NO: 1397452 - protein, 9 aa, Homo Sapiens
NIPLQTVAN

SEQ ID NO: 1397453 - protein, 9 aa, Homo Sapiens
SHHSVSCSN

SEQ ID NO: 1397454 - protein, 9 aa, Homo Sapiens
TEPPLPTAS

SEQ ID NO: 1397455 - protein, 9 aa, Homo Sapiens
TPIPTGSRR

SEQ ID NO: 1397456 - protein, 9 aa, Homo Sapiens
VIVGHGHEA

SEQ ID NO: 1397457 - protein, 9 aa, Homo Sapiens
TILFWTPPS

SEQ ID NO: 1397458 - protein, 9 aa, Homo Sapiens
HLLYYTEFL

SEQ ID NO: 1397459 - protein, 9 aa, Homo Sapiens
SLPCFLELR

SEQ ID NO: 1397460 - protein, 9 aa, Homo Sapiens
SHRVLVAHY

SEQ ID NO: 1397461 - protein, 9 aa, Homo Sapiens
YCISIARRE

SEQ ID NO: 1397462 - protein, 9 aa, Homo Sapiens
NPFLPSMPG

SEQ ID NO: 1397463 - protein, 9 aa, Homo Sapiens
IRGALTTRP

SEQ ID NO: 1397464 - protein, 9 aa, Homo Sapiens
VLSQVQLSE

SEQ ID NO: 1397465 - protein, 9 aa, Homo Sapiens
QNHRVKHKK

SEQ ID NO: 1397466 - protein, 9 aa, Homo Sapiens
QRTLYRDMM

SEQ ID NO: 1397467 - protein, 9 aa, Homo Sapiens
KTWQRRLRA

SEQ ID NO: 1397468 - protein, 9 aa, Homo Sapiens
LLYTLGAVQ

SEQ ID NO: 1397469 - protein, 9 aa, Homo Sapiens
SVGSTSGNR

SEQ ID NO: 1397470 - protein, 9 aa, Homo Sapiens
PLWTIPVTV

SEQ ID NO: 1397471 - protein, 9 aa, Homo Sapiens
GRVEGLLYG

SEQ ID NO: 1397472 - protein, 9 aa, Homo Sapiens
CRIEIEENK

SEQ ID NO: 1397473 - protein, 9 aa, Homo Sapiens
TLSFPLLIT

SEQ ID NO: 1397474 - protein, 9 aa, Homo Sapiens
DMRPFLAKE

SEQ ID NO: 1397475 - protein, 9 aa, Homo Sapiens
EMDNTGQLV

SEQ ID NO: 1397476 - protein, 9 aa, Homo Sapiens
SHFSRCSWI

SEQ ID NO: 1397477 - protein, 9 aa, Homo Sapiens
PHCSETART

SEQ ID NO: 1397478 - protein, 9 aa, Homo Sapiens
QYERIITSR

SEQ ID NO: 1397479 - protein, 9 aa, Homo Sapiens
CPRPLSSKL

SEQ ID NO: 1397480 - protein, 9 aa, Homo Sapiens
GLLLLSPAS

SEQ ID NO: 1397481 - protein, 9 aa, Homo Sapiens
DPKKRSKKV

SEQ ID NO: 1397482 - protein, 9 aa, Homo Sapiens
CYEGTCSKK

SEQ ID NO: 1397483 - protein, 9 aa, Homo Sapiens
LAYIQSLPP

SEQ ID NO: 1397484 - protein, 9 aa, Homo Sapiens
WWGPSRDSL

SEQ ID NO: 1397485 - protein, 9 aa, Homo Sapiens
VKEEANKAM

SEQ ID NO: 1397486 - protein, 9 aa, Homo Sapiens
RFRIHCQEV

SEQ ID NO: 1397487 - protein, 9 aa, Homo Sapiens
CPFIETSAK

SEQ ID NO: 1397488 - protein, 9 aa, Homo Sapiens
PHGLQSGCG

SEQ ID NO: 1397489 - protein, 9 aa, Homo Sapiens
LHQPLPGQH

SEQ ID NO: 1397490 - protein, 9 aa, Homo Sapiens
CMAVTRQFP

SEQ ID NO: 1397491 - protein, 9 aa, Homo Sapiens
LCFWTPHSP

SEQ ID NO: 1397492 - protein, 9 aa, Homo Sapiens
DGDAHSSGL

SEQ ID NO: 1397493 - protein, 9 aa, Homo Sapiens
SLASGAPGL

SEQ ID NO: 1397494 - protein, 9 aa, Homo Sapiens
WYSEGAFND

SEQ ID NO: 1397495 - protein, 9 aa, Homo Sapiens
QFVSQINHK

SEQ ID NO: 1397496 - protein, 9 aa, Homo Sapiens
TLAPNVNME

SEQ ID NO: 1397497 - protein, 9 aa, Homo Sapiens
SEGAFNDNE

SEQ ID NO: 1397498 - protein, 9 aa, Homo Sapiens
FPGWFFGEQ

SEQ ID NO: 1397499 - protein, 9 aa, Homo Sapiens
ESSILSSTL

SEQ ID NO: 1397500 - protein, 9 aa, Homo Sapiens
LFMNIQEDI

SEQ ID NO: 1397501 - protein, 9 aa, Homo Sapiens
HLPTISRGE

SEQ ID NO: 1397502 - protein, 9 aa, Homo Sapiens
ASVRPVEDL

SEQ ID NO: 1397503 - protein, 9 aa, Homo Sapiens
SDSPPLQDG

SEQ ID NO: 1397504 - protein, 9 aa, Homo Sapiens
QGPDKENPG

SEQ ID NO: 1397505 - protein, 9 aa, Homo Sapiens
LICDQLFLK

SEQ ID NO: 1397506 - protein, 9 aa, Homo Sapiens
LFSQYERII

SEQ ID NO: 1397507 - protein, 9 aa, Homo Sapiens
GRWRLDSSA

SEQ ID NO: 1397508 - protein, 9 aa, Homo Sapiens
LVQSLHQEL

SEQ ID NO: 1397509 - protein, 9 aa, Homo Sapiens
CQKSLQKIC

SEQ ID NO: 1397510 - protein, 9 aa, Homo Sapiens
WTAPLRPLS

SEQ ID NO: 1397511 - protein, 9 aa, Homo Sapiens
EASWQPACG

SEQ ID NO: 1397512 - protein, 9 aa, Homo Sapiens
RSSPVPPVL

SEQ ID NO: 1397513 - protein, 9 aa, Homo Sapiens
TSEVSLFTP

SEQ ID NO: 1397514 - protein, 9 aa, Homo Sapiens
VAGATAQIQ

SEQ ID NO: 1397515 - protein, 9 aa, Homo Sapiens
RDPMLSPSA

SEQ ID NO: 1397516 - protein, 9 aa, Homo Sapiens
APLASAPEV

SEQ ID NO: 1397517 - protein, 9 aa, Homo Sapiens
HGCPSQLRG

SEQ ID NO: 1397518 - protein, 9 aa, Homo Sapiens
APRPCWSRC

SEQ ID NO: 1397519 - protein, 9 aa, Homo Sapiens
PLKRDPQQG

SEQ ID NO: 1397520 - protein, 9 aa, Homo Sapiens
GKAKSHCLD

SEQ ID NO: 1397521 - protein, 9 aa, Homo Sapiens
SQSEDGVRA

SEQ ID NO: 1397522 - protein, 9 aa, Homo Sapiens
LQKICSLLI

SEQ ID NO: 1397523 - protein, 9 aa, Homo Sapiens
WRLSSLPCF

SEQ ID NO: 1397524 - protein, 9 aa, Homo Sapiens
ENLSKVIPQ

SEQ ID NO: 1397525 - protein, 9 aa, Homo Sapiens
RACTPASGP

SEQ ID NO: 1397526 - protein, 9 aa, Homo Sapiens
LLSDERLCR

SEQ ID NO: 1397527 - protein, 9 aa, Homo Sapiens
VRVGVQTVQ

SEQ ID NO: 1397528 - protein, 9 aa, Homo Sapiens
TYCHLYSLS

SEQ ID NO: 1397529 - protein, 9 aa, Homo Sapiens
CWSRCSLRQ

SEQ ID NO: 1397530 - protein, 9 aa, Homo Sapiens
TGPKAPCPG

SEQ ID NO: 1397531 - protein, 9 aa, Homo Sapiens
PQRVQTPLL

SEQ ID NO: 1397532 - protein, 9 aa, Homo Sapiens
GSTARGCRN

SEQ ID NO: 1397533 - protein, 9 aa, Homo Sapiens
EIGNHYMEM

SEQ ID NO: 1397534 - protein, 9 aa, Homo Sapiens
RWSRSPRMR

SEQ ID NO: 1397535 - protein, 9 aa, Homo Sapiens
PVGAMVNMD

SEQ ID NO: 1397536 - protein, 9 aa, Homo Sapiens
PLVVCRSRS

SEQ ID NO: 1397537 - protein, 9 aa, Homo Sapiens
KRRWSRSPR

SEQ ID NO: 1397538 - protein, 9 aa, Homo Sapiens
SPILNAEEL

SEQ ID NO: 1397539 - protein, 9 aa, Homo Sapiens
LGSIIAEVH

SEQ ID NO: 1397540 - protein, 9 aa, Homo Sapiens
GAEGGGGQD

SEQ ID NO: 1397541 - protein, 9 aa, Homo Sapiens
FEWNLKSGC

SEQ ID NO: 1397542 - protein, 9 aa, Homo Sapiens
SARSLGICV

SEQ ID NO: 1397543 - protein, 9 aa, Homo Sapiens
ERGRTQPSF

SEQ ID NO: 1397544 - protein, 9 aa, Homo Sapiens
PQTGANSLS

SEQ ID NO: 1397545 - protein, 9 aa, Homo Sapiens
VHDVVNRGG

SEQ ID NO: 1397546 - protein, 9 aa, Homo Sapiens
MVRSGGSPI

SEQ ID NO: 1397547 - protein, 9 aa, Homo Sapiens
EDRGIDRVT

SEQ ID NO: 1397548 - protein, 9 aa, Homo Sapiens
GGTTIGEVT

SEQ ID NO: 1397549 - protein, 9 aa, Homo Sapiens
AGDGHGRLV

SEQ ID NO: 1397550 - protein, 9 aa, Homo Sapiens
SIARRERPS

SEQ ID NO: 1397551 - protein, 9 aa, Homo Sapiens
ALCVLKGGL

SEQ ID NO: 1397552 - protein, 9 aa, Homo Sapiens
GKTGWSTRG

SEQ ID NO: 1397553 - protein, 9 aa, Homo Sapiens
LTPPPAATS

SEQ ID NO: 1397554 - protein, 9 aa, Homo Sapiens
LVQRTVAHQ

SEQ ID NO: 1397555 - protein, 9 aa, Homo Sapiens
ALRTLTEYA

SEQ ID NO: 1397556 - protein, 9 aa, Homo Sapiens
GFLFLSGHI

SEQ ID NO: 1397557 - protein, 9 aa, Homo Sapiens
ENAVLIRVI

SEQ ID NO: 1397558 - protein, 9 aa, Homo Sapiens
GPWHHWNQR

SEQ ID NO: 1397559 - protein, 9 aa, Homo Sapiens
KIYLQTTDY

SEQ ID NO: 1397560 - protein, 9 aa, Homo Sapiens
TEAEKGKEH

SEQ ID NO: 1397561 - protein, 9 aa, Homo Sapiens
QNWRMKMKK

SEQ ID NO: 1397562 - protein, 9 aa, Homo Sapiens
IVPHLLLMK

SEQ ID NO: 1397563 - protein, 9 aa, Homo Sapiens
CQMCAACGP

SEQ ID NO: 1397564 - protein, 9 aa, Homo Sapiens
LKICDFGTT

SEQ ID NO: 1397565 - protein, 9 aa, Homo Sapiens
RAAAARKPH

SEQ ID NO: 1397566 - protein, 9 aa, Homo Sapiens
WEPTWLERQ

SEQ ID NO: 1397567 - protein, 9 aa, Homo Sapiens
GIDRVTIYS

SEQ ID NO: 1397568 - protein, 9 aa, Homo Sapiens
MSLVIFVQN

SEQ ID NO: 1397569 - protein, 9 aa, Homo Sapiens
PSPRPPPLV

SEQ ID NO: 1397570 - protein, 9 aa, Homo Sapiens
HAQYEEIAQ

SEQ ID NO: 1397571 - protein, 9 aa, Homo Sapiens
PRASLRATV

SEQ ID NO: 1397572 - protein, 9 aa, Homo Sapiens
RSLGICVVK

SEQ ID NO: 1397573 - protein, 9 aa, Homo Sapiens
NPPENPEQA

SEQ ID NO: 1397574 - protein, 9 aa, Homo Sapiens
PKKAFCEPL

SEQ ID NO: 1397575 - protein, 9 aa, Homo Sapiens
HTRLWMATM

SEQ ID NO: 1397576 - protein, 9 aa, Homo Sapiens
LSVPTILYS

SEQ ID NO: 1397577 - protein, 9 aa, Homo Sapiens
ISAFSSKVV

SEQ ID NO: 1397578 - protein, 9 aa, Homo Sapiens
KALHGVTEG

SEQ ID NO: 1397579 - protein, 9 aa, Homo Sapiens
FSCHIRAGP

SEQ ID NO: 1397580 - protein, 9 aa, Homo Sapiens
PSCSRGSQR

SEQ ID NO: 1397581 - protein, 9 aa, Homo Sapiens
VDWKMTNVQ

SEQ ID NO: 1397582 - protein, 9 aa, Homo Sapiens
GVLTEKQEE

SEQ ID NO: 1397583 - protein, 9 aa, Homo Sapiens
RVWGAAAAA

SEQ ID NO: 1397584 - protein, 9 aa, Homo Sapiens
NTTCLFCGN

SEQ ID NO: 1397585 - protein, 9 aa, Homo Sapiens
KNLNFSVIV

SEQ ID NO: 1397586 - protein, 9 aa, Homo Sapiens
VYTCISVNT

SEQ ID NO: 1397587 - protein, 9 aa, Homo Sapiens
AREEGYYYR

SEQ ID NO: 1397588 - protein, 9 aa, Homo Sapiens
PSQGILGST

SEQ ID NO: 1397589 - protein, 9 aa, Homo Sapiens
FLNFNPDHI

SEQ ID NO: 1397590 - protein, 9 aa, Homo Sapiens
WPSLESSGY

SEQ ID NO: 1397591 - protein, 9 aa, Homo Sapiens
GFVLPLVVL

SEQ ID NO: 1397592 - protein, 9 aa, Homo Sapiens
PDPSMTTSC

SEQ ID NO: 1397593 - protein, 9 aa, Homo Sapiens
KQGLGPPAP

SEQ ID NO: 1397594 - protein, 9 aa, Homo Sapiens
PLPTASGLK

SEQ ID NO: 1397595 - protein, 9 aa, Homo Sapiens
SVPWRLSSL

SEQ ID NO: 1397596 - protein, 9 aa, Homo Sapiens
EITDDLDVG

SEQ ID NO: 1397597 - protein, 9 aa, Homo Sapiens
VPPLSRARS

SEQ ID NO: 1397598 - protein, 9 aa, Homo Sapiens
WGPQTILLA

SEQ ID NO: 1397599 - protein, 9 aa, Homo Sapiens
IDLEVDNGA

SEQ ID NO: 1397600 - protein, 9 aa, Homo Sapiens
SLPKSSPLP

SEQ ID NO: 1397601 - protein, 9 aa, Homo Sapiens
GKTDPNSRI

SEQ ID NO: 1397602 - protein, 9 aa, Homo Sapiens
KVSVELLRA

SEQ ID NO: 1397603 - protein, 9 aa, Homo Sapiens
AIHTKLEEA

SEQ ID NO: 1397604 - protein, 9 aa, Homo Sapiens
HDAPPPPTP

SEQ ID NO: 1397605 - protein, 9 aa, Homo Sapiens
RCWKYTTES

SEQ ID NO: 1397606 - protein, 9 aa, Homo Sapiens
SCGPTSGST

SEQ ID NO: 1397607 - protein, 9 aa, Homo Sapiens
TFPGWFFGE

SEQ ID NO: 1397608 - protein, 9 aa, Homo Sapiens
ILKIIRRRL

SEQ ID NO: 1397609 - protein, 9 aa, Homo Sapiens
WRGWWGNGW

SEQ ID NO: 1397610 - protein, 9 aa, Homo Sapiens
TTCDIQTHM

SEQ ID NO: 1397611 - protein, 9 aa, Homo Sapiens
TMPLLHIRG

SEQ ID NO: 1397612 - protein, 9 aa, Homo Sapiens
GIRGALTTR

SEQ ID NO: 1397613 - protein, 9 aa, Homo Sapiens
ARRRTWWRT

SEQ ID NO: 1397614 - protein, 9 aa, Homo Sapiens
IQRMHLCQY

SEQ ID NO: 1397615 - protein, 9 aa, Homo Sapiens
TSSPRRSPA

SEQ ID NO: 1397616 - protein, 9 aa, Homo Sapiens
RAANHDVGS

SEQ ID NO: 1397617 - protein, 9 aa, Homo Sapiens
NFFVTLLYV

SEQ ID NO: 1397618 - protein, 9 aa, Homo Sapiens
RLWCFPQPP

SEQ ID NO: 1397619 - protein, 9 aa, Homo Sapiens
HKAQFVSQI

SEQ ID NO: 1397620 - protein, 9 aa, Homo Sapiens
DGMLTVIGQ

SEQ ID NO: 1397621 - protein, 9 aa, Homo Sapiens
PRSRPGPQG

SEQ ID NO: 1397622 - protein, 9 aa, Homo Sapiens
ERAQSAEEP

SEQ ID NO: 1397623 - protein, 9 aa, Homo Sapiens
QIWLQINKP

SEQ ID NO: 1397624 - protein, 9 aa, Homo Sapiens
PVTVLKSAG

SEQ ID NO: 1397625 - protein, 9 aa, Homo Sapiens
RTAVIREDP

SEQ ID NO: 1397626 - protein, 9 aa, Homo Sapiens
AQESGHKKV

SEQ ID NO: 1397627 - protein, 9 aa, Homo Sapiens
VGSLINEQW

SEQ ID NO: 1397628 - protein, 9 aa, Homo Sapiens
LRACRAGGP

SEQ ID NO: 1397629 - protein, 9 aa, Homo Sapiens
WKNSESMKK

SEQ ID NO: 1397630 - protein, 9 aa, Homo Sapiens
SITMGTARP

SEQ ID NO: 1397631 - protein, 9 aa, Homo Sapiens
LLAEERQEI

SEQ ID NO: 1397632 - protein, 9 aa, Homo Sapiens
ARPGTCAAR

SEQ ID NO: 1397633 - protein, 9 aa, Homo Sapiens
DGSDEEVCG

SEQ ID NO: 1397634 - protein, 9 aa, Homo Sapiens
HWRAWWQEN

SEQ ID NO: 1397635 - protein, 9 aa, Homo Sapiens
RDQKREKKN

SEQ ID NO: 1397636 - protein, 9 aa, Homo Sapiens
SSSPSSLPQ

SEQ ID NO: 1397637 - protein, 9 aa, Homo Sapiens
NIQEDILSL

SEQ ID NO: 1397638 - protein, 9 aa, Homo Sapiens
RIHTGVKPN

SEQ ID NO: 1397639 - protein, 9 aa, Homo Sapiens
PFIETSAKS

SEQ ID NO: 1397640 - protein, 9 aa, Homo Sapiens
DAGFQQQTE

SEQ ID NO: 1397641 - protein, 9 aa, Homo Sapiens
CLLGPVLLS

SEQ ID NO: 1397642 - protein, 9 aa, Homo Sapiens
VPTAARPSA

SEQ ID NO: 1397643 - protein, 9 aa, Homo Sapiens
GSALQVMGM

SEQ ID NO: 1397644 - protein, 9 aa, Homo Sapiens
GDVASMYTQ

SEQ ID NO: 1397645 - protein, 9 aa, Homo Sapiens
ARGPVRLLL

SEQ ID NO: 1397646 - protein, 9 aa, Homo Sapiens
FSLLYEEAH

SEQ ID NO: 1397647 - protein, 9 aa, Homo Sapiens
RSPTSAPTA

SEQ ID NO: 1397648 - protein, 9 aa, Homo Sapiens
HRLLQEQHQ

SEQ ID NO: 1397649 - protein, 9 aa, Homo Sapiens
GRLCVDAGF

SEQ ID NO: 1397650 - protein, 9 aa, Homo Sapiens
ACRWPSLES

SEQ ID NO: 1397651 - protein, 9 aa, Homo Sapiens
PMLKAIEMF

SEQ ID NO: 1397652 - protein, 9 aa, Homo Sapiens
LTEYARPHV

SEQ ID NO: 1397653 - protein, 9 aa, Homo Sapiens
NPPLVVCRS

SEQ ID NO: 1397654 - protein, 9 aa, Homo Sapiens
IRPGVAYRF

SEQ ID NO: 1397655 - protein, 9 aa, Homo Sapiens
PVLSSTMLP

SEQ ID NO: 1397656 - protein, 9 aa, Homo Sapiens
ISFCIVLCM

SEQ ID NO: 1397657 - protein, 9 aa, Homo Sapiens
VKCGRVEGL

SEQ ID NO: 1397658 - protein, 9 aa, Homo Sapiens
GAWKSIFRL

SEQ ID NO: 1397659 - protein, 9 aa, Homo Sapiens
VLSSTMLPV

SEQ ID NO: 1397660 - protein, 9 aa, Homo Sapiens
TASHKSTSS

SEQ ID NO: 1397661 - protein, 9 aa, Homo Sapiens
STTHKELQE

SEQ ID NO: 1397662 - protein, 9 aa, Homo Sapiens
DYVGGYFGH

SEQ ID NO: 1397663 - protein, 9 aa, Homo Sapiens
PPPRARPGT

SEQ ID NO: 1397664 - protein, 9 aa, Homo Sapiens
ECNHPWSIC

SEQ ID NO: 1397665 - protein, 9 aa, Homo Sapiens
TQTVLGPSV

SEQ ID NO: 1397666 - protein, 9 aa, Homo Sapiens
LFQVATTEM

SEQ ID NO: 1397667 - protein, 9 aa, Homo Sapiens
ELCKNAGPR

SEQ ID NO: 1397668 - protein, 9 aa, Homo Sapiens
KIIRRRLPF

SEQ ID NO: 1397669 - protein, 9 aa, Homo Sapiens
WFTSRVQKN

SEQ ID NO: 1397670 - protein, 9 aa, Homo Sapiens
DIKPLPPNT

SEQ ID NO: 1397671 - protein, 9 aa, Homo Sapiens
TYLIFCDNY

SEQ ID NO: 1397672 - protein, 9 aa, Homo Sapiens
PLPGQHLWL

SEQ ID NO: 1397673 - protein, 9 aa, Homo Sapiens
TRIAWQSIT

SEQ ID NO: 1397674 - protein, 9 aa, Homo Sapiens
YLVDKHEKK

SEQ ID NO: 1397675 - protein, 9 aa, Homo Sapiens
TIVLLNSTD

SEQ ID NO: 1397676 - protein, 9 aa, Homo Sapiens
SFKEHFSLR

SEQ ID NO: 1397677 - protein, 9 aa, Homo Sapiens
GARAEPGGR

SEQ ID NO: 1397678 - protein, 9 aa, Homo Sapiens
ATRIACAHY

SEQ ID NO: 1397679 - protein, 9 aa, Homo Sapiens
IVTAASVFY

SEQ ID NO: 1397680 - protein, 9 aa, Homo Sapiens
SQDHTVRIW

SEQ ID NO: 1397681 - protein, 9 aa, Homo Sapiens
RALQASYTP

SEQ ID NO: 1397682 - protein, 9 aa, Homo Sapiens
NAGPRIKCV

SEQ ID NO: 1397683 - protein, 9 aa, Homo Sapiens
IMQYGNKTI

SEQ ID NO: 1397684 - protein, 9 aa, Homo Sapiens
SHISSARQL

SEQ ID NO: 1397685 - protein, 9 aa, Homo Sapiens
EPSKALHGV

SEQ ID NO: 1397686 - protein, 9 aa, Homo Sapiens
KPGWQRLDQ

SEQ ID NO: 1397687 - protein, 9 aa, Homo Sapiens
HNHYGGKEY

SEQ ID NO: 1397688 - protein, 9 aa, Homo Sapiens
SMRPDGRPE

SEQ ID NO: 1397689 - protein, 9 aa, Homo Sapiens
FQMVISNPA

SEQ ID NO: 1397690 - protein, 9 aa, Homo Sapiens
PWGRSRAGL

SEQ ID NO: 1397691 - protein, 9 aa, Homo Sapiens
ESHISSARQ

SEQ ID NO: 1397692 - protein, 9 aa, Homo Sapiens
CLLPQQRFC

SEQ ID NO: 1397693 - protein, 9 aa, Homo Sapiens
HQGPWHHWN

SEQ ID NO: 1397694 - protein, 9 aa, Homo Sapiens
AGPPAGAFG

SEQ ID NO: 1397695 - protein, 9 aa, Homo Sapiens
SSPVGRLCC

SEQ ID NO: 1397696 - protein, 9 aa, Homo Sapiens
QHREDILNA

SEQ ID NO: 1397697 - protein, 9 aa, Homo Sapiens
ISSWQVLFM

SEQ ID NO: 1397698 - protein, 9 aa, Homo Sapiens
VTTWASLAT

SEQ ID NO: 1397699 - protein, 9 aa, Homo Sapiens
SFNYKSIII

SEQ ID NO: 1397700 - protein, 9 aa, Homo Sapiens
KVLNKKKCR

SEQ ID NO: 1397701 - protein, 9 aa, Homo Sapiens
KLVEEMLGL

SEQ ID NO: 1397702 - protein, 9 aa, Homo Sapiens
LFQPDLCNV

SEQ ID NO: 1397703 - protein, 9 aa, Homo Sapiens
AELSQLFIL

SEQ ID NO: 1397704 - protein, 9 aa, Homo Sapiens
TTGWLERAY

SEQ ID NO: 1397705 - protein, 9 aa, Homo Sapiens
RLEKPSALD

SEQ ID NO: 1397706 - protein, 9 aa, Homo Sapiens
KPSSSPKAR

SEQ ID NO: 1397707 - protein, 9 aa, Homo Sapiens
ARHDIRREE

SEQ ID NO: 1397708 - protein, 9 aa, Homo Sapiens
CQKMYEHLW

SEQ ID NO: 1397709 - protein, 9 aa, Homo Sapiens
RTGASTPAR

SEQ ID NO: 1397710 - protein, 9 aa, Homo Sapiens
VVNAKKKCH

SEQ ID NO: 1397711 - protein, 9 aa, Homo Sapiens
VNAKKKCHS

SEQ ID NO: 1397712 - protein, 9 aa, Homo Sapiens
KTVMITWKE

SEQ ID NO: 1397713 - protein, 9 aa, Homo Sapiens
VKTVMITWK

SEQ ID NO: 1397714 - protein, 9 aa, Homo Sapiens
RAGPNKILR

SEQ ID NO: 1397715 - protein, 9 aa, Homo Sapiens
SFNYLRLVV

SEQ ID NO: 1397716 - protein, 9 aa, Homo Sapiens
MLGFFVLYY

SEQ ID NO: 1397717 - protein, 9 aa, Homo Sapiens
ALKICACIN

SEQ ID NO: 1397718 - protein, 9 aa, Homo Sapiens
EATHCKYYS

SEQ ID NO: 1397719 - protein, 9 aa, Homo Sapiens
GVVHLVLHR

SEQ ID NO: 1397720 - protein, 9 aa, Homo Sapiens
NKITPPFNP

SEQ ID NO: 1397721 - protein, 9 aa, Homo Sapiens
MKTAGKPWL

SEQ ID NO: 1397722 - protein, 9 aa, Homo Sapiens
SPLSTLKPP

SEQ ID NO: 1397723 - protein, 9 aa, Homo Sapiens
PSQLRGSSP

SEQ ID NO: 1397724 - protein, 9 aa, Homo Sapiens
GGAPSAFDR

SEQ ID NO: 1397725 - protein, 9 aa, Homo Sapiens
FSTPEGYDH

SEQ ID NO: 1397726 - protein, 9 aa, Homo Sapiens
RRERRSDSE

SEQ ID NO: 1397727 - protein, 9 aa, Homo Sapiens
IASGSENHK

SEQ ID NO: 1397728 - protein, 9 aa, Homo Sapiens
GGIIMALGA

SEQ ID NO: 1397729 - protein, 9 aa, Homo Sapiens
RKKMFLIQR

SEQ ID NO: 1397730 - protein, 9 aa, Homo Sapiens
YHVGCTNVR

SEQ ID NO: 1397731 - protein, 9 aa, Homo Sapiens
QDPIEAPPP

SEQ ID NO: 1397732 - protein, 9 aa, Homo Sapiens
PSAGTMLSE

SEQ ID NO: 1397733 - protein, 9 aa, Homo Sapiens
RLEAHFQDV

SEQ ID NO: 1397734 - protein, 9 aa, Homo Sapiens
PARSAAAAS

SEQ ID NO: 1397735 - protein, 9 aa, Homo Sapiens
RVGVQTVQQ

SEQ ID NO: 1397736 - protein, 9 aa, Homo Sapiens
QLEFKRISA

SEQ ID NO: 1397737 - protein, 9 aa, Homo Sapiens
ASGRGCLLP

SEQ ID NO: 1397738 - protein, 9 aa, Homo Sapiens
ELLLSQYPW

SEQ ID NO: 1397739 - protein, 9 aa, Homo Sapiens
NSTPPQRVQ

SEQ ID NO: 1397740 - protein, 9 aa, Homo Sapiens
SSLLCSGQG

SEQ ID NO: 1397741 - protein, 9 aa, Homo Sapiens
AHPMLKAIE

SEQ ID NO: 1397742 - protein, 9 aa, Homo Sapiens
LVPILEIPT

SEQ ID NO: 1397743 - protein, 9 aa, Homo Sapiens
SRSWAWTCP

SEQ ID NO: 1397744 - protein, 9 aa, Homo Sapiens
GSRTPIPTG

SEQ ID NO: 1397745 - protein, 9 aa, Homo Sapiens
EIENLMSQE

SEQ ID NO: 1397746 - protein, 9 aa, Homo Sapiens
KFGTMPLLH

SEQ ID NO: 1397747 - protein, 9 aa, Homo Sapiens
ATDLQLSTP

SEQ ID NO: 1397748 - protein, 9 aa, Homo Sapiens
HQHEDCCLR

SEQ ID NO: 1397749 - protein, 9 aa, Homo Sapiens
HHWNKVLCF

SEQ ID NO: 1397750 - protein, 9 aa, Homo Sapiens
WLSPLTEGP

SEQ ID NO: 1397751 - protein, 9 aa, Homo Sapiens
SVWPVESHP

SEQ ID NO: 1397752 - protein, 9 aa, Homo Sapiens
SLATAWEPT

SEQ ID NO: 1397753 - protein, 9 aa, Homo Sapiens
TPENGPETS

SEQ ID NO: 1397754 - protein, 9 aa, Homo Sapiens
ILHQNLVYL

SEQ ID NO: 1397755 - protein, 9 aa, Homo Sapiens
GSTGCSLGS

SEQ ID NO: 1397756 - protein, 9 aa, Homo Sapiens
GIIMALGAL

SEQ ID NO: 1397757 - protein, 9 aa, Homo Sapiens
WRQDRGGPL

SEQ ID NO: 1397758 - protein, 9 aa, Homo Sapiens
MQFSLFSVM

SEQ ID NO: 1397759 - protein, 9 aa, Homo Sapiens
KFAEQDVKE

SEQ ID NO: 1397760 - protein, 9 aa, Homo Sapiens
GPEEIEADS

SEQ ID NO: 1397761 - protein, 9 aa, Homo Sapiens
RCTPQPRPS

SEQ ID NO: 1397762 - protein, 9 aa, Homo Sapiens
GVIEFYILT

SEQ ID NO: 1397763 - protein, 9 aa, Homo Sapiens
PVDDARPPA

SEQ ID NO: 1397764 - protein, 9 aa, Homo Sapiens
WLYCMKVLV

SEQ ID NO: 1397765 - protein, 9 aa, Homo Sapiens
SGYHFCVGS

SEQ ID NO: 1397766 - protein, 9 aa, Homo Sapiens
PAGRGAPRH

SEQ ID NO: 1397767 - protein, 9 aa, Homo Sapiens
SRCSWISSQ

SEQ ID NO: 1397768 - protein, 9 aa, Homo Sapiens
HPHRSPPTS

SEQ ID NO: 1397769 - protein, 9 aa, Homo Sapiens
LICCGYIPS

SEQ ID NO: 1397770 - protein, 9 aa, Homo Sapiens
EGIYRWPGD

SEQ ID NO: 1397771 - protein, 9 aa, Homo Sapiens
NVDLVLVPQ

SEQ ID NO: 1397772 - protein, 9 aa, Homo Sapiens
RVILEVLQS

SEQ ID NO: 1397773 - protein, 9 aa, Homo Sapiens
STLWNFCLL

SEQ ID NO: 1397774 - protein, 9 aa, Homo Sapiens
MTRFWRWSP

SEQ ID NO: 1397775 - protein, 9 aa, Homo Sapiens
LLWRLFLII

SEQ ID NO: 1397776 - protein, 9 aa, Homo Sapiens
HCSETARTM

SEQ ID NO: 1397777 - protein, 9 aa, Homo Sapiens
TARAPLPPT

SEQ ID NO: 1397778 - protein, 9 aa, Homo Sapiens
MFNSNSGVM

SEQ ID NO: 1397779 - protein, 9 aa, Homo Sapiens
MPGGLAGAM

SEQ ID NO: 1397780 - protein, 9 aa, Homo Sapiens
EAISRICEA

SEQ ID NO: 1397781 - protein, 9 aa, Homo Sapiens
QQLARQLMH

SEQ ID NO: 1397782 - protein, 9 aa, Homo Sapiens
QWNPPLVVC

SEQ ID NO: 1397783 - protein, 9 aa, Homo Sapiens
MPVPACWIS

SEQ ID NO: 1397784 - protein, 9 aa, Homo Sapiens
VPVQPEVTQ

SEQ ID NO: 1397785 - protein, 9 aa, Homo Sapiens
INSLTILDD

SEQ ID NO: 1397786 - protein, 9 aa, Homo Sapiens
RKQEEEEGI

SEQ ID NO: 1397787 - protein, 9 aa, Homo Sapiens
PPENPEQAV

SEQ ID NO: 1397788 - protein, 9 aa, Homo Sapiens
ERDQKREKK

SEQ ID NO: 1397789 - protein, 9 aa, Homo Sapiens
VDLRKALKF

SEQ ID NO: 1397790 - protein, 9 aa, Homo Sapiens
YICDRGFVL

SEQ ID NO: 1397791 - protein, 9 aa, Homo Sapiens
SPTSSPTAR

SEQ ID NO: 1397792 - protein, 9 aa, Homo Sapiens
EMQLWRQDR

SEQ ID NO: 1397793 - protein, 9 aa, Homo Sapiens
SRAVLVERG

SEQ ID NO: 1397794 - protein, 9 aa, Homo Sapiens
GVVDPGKAS

SEQ ID NO: 1397795 - protein, 9 aa, Homo Sapiens
SRRHRDRHF

SEQ ID NO: 1397796 - protein, 9 aa, Homo Sapiens
SNYLVDKHE

SEQ ID NO: 1397797 - protein, 9 aa, Homo Sapiens
AWWQENLSK

SEQ ID NO: 1397798 - protein, 9 aa, Homo Sapiens
VCSSLTTHQ

SEQ ID NO: 1397799 - protein, 9 aa, Homo Sapiens
GPVSPATTR

SEQ ID NO: 1397800 - protein, 9 aa, Homo Sapiens
GSTASVGGS

SEQ ID NO: 1397801 - protein, 9 aa, Homo Sapiens
HDVVNRGGR

SEQ ID NO: 1397802 - protein, 9 aa, Homo Sapiens
GLCSKTVDY

SEQ ID NO: 1397803 - protein, 9 aa, Homo Sapiens
SSSTILFWT

SEQ ID NO: 1397804 - protein, 9 aa, Homo Sapiens
CPGLVPLPL

SEQ ID NO: 1397805 - protein, 9 aa, Homo Sapiens
WCRTGASTR

SEQ ID NO: 1397806 - protein, 9 aa, Homo Sapiens
RKCFPGNQH

SEQ ID NO: 1397807 - protein, 9 aa, Homo Sapiens
TSQNHSKCI

SEQ ID NO: 1397808 - protein, 9 aa, Homo Sapiens
ETLALVGGE

SEQ ID NO: 1397809 - protein, 9 aa, Homo Sapiens
SGQGTASPT

SEQ ID NO: 1397810 - protein, 9 aa, Homo Sapiens
TVHDVVNRG

SEQ ID NO: 1397811 - protein, 9 aa, Homo Sapiens
VSLFTPRPG

SEQ ID NO: 1397812 - protein, 9 aa, Homo Sapiens
DHTRADLIS

SEQ ID NO: 1397813 - protein, 9 aa, Homo Sapiens
EYLKSPPSA

SEQ ID NO: 1397814 - protein, 9 aa, Homo Sapiens
RSWQLDANP

SEQ ID NO: 1397815 - protein, 9 aa, Homo Sapiens
FSRQVRVTV

SEQ ID NO: 1397816 - protein, 9 aa, Homo Sapiens
CISVKDHRT

SEQ ID NO: 1397817 - protein, 9 aa, Homo Sapiens
IGPVEAAIH

SEQ ID NO: 1397818 - protein, 9 aa, Homo Sapiens
DLCNVDLVL

SEQ ID NO: 1397819 - protein, 9 aa, Homo Sapiens
SHQAYGASL

SEQ ID NO: 1397820 - protein, 9 aa, Homo Sapiens
TVTLAPNVN

SEQ ID NO: 1397821 - protein, 9 aa, Homo Sapiens
TLCLLQHQG

SEQ ID NO: 1397822 - protein, 9 aa, Homo Sapiens
FQDKRVLVI

SEQ ID NO: 1397823 - protein, 9 aa, Homo Sapiens
RALHRQYGD

SEQ ID NO: 1397824 - protein, 9 aa, Homo Sapiens
ASSKEDLLV

SEQ ID NO: 1397825 - protein, 9 aa, Homo Sapiens
PPQRVQTPL

SEQ ID NO: 1397826 - protein, 9 aa, Homo Sapiens
AGASGWSAS

SEQ ID NO: 1397827 - protein, 9 aa, Homo Sapiens
KNCIYPLSM

SEQ ID NO: 1397828 - protein, 9 aa, Homo Sapiens
PTGAAGAAS

SEQ ID NO: 1397829 - protein, 9 aa, Homo Sapiens
EEEDTDPRH

SEQ ID NO: 1397830 - protein, 9 aa, Homo Sapiens
LFYTYKGKS

SEQ ID NO: 1397831 - protein, 9 aa, Homo Sapiens
GGHRLCVRP

SEQ ID NO: 1397832 - protein, 9 aa, Homo Sapiens
WHCGSAACH

SEQ ID NO: 1397833 - protein, 9 aa, Homo Sapiens
DRERRATRI

SEQ ID NO: 1397834 - protein, 9 aa, Homo Sapiens
RGGTNGGSS

SEQ ID NO: 1397835 - protein, 9 aa, Homo Sapiens
QVRVTVLLL

SEQ ID NO: 1397836 - protein, 9 aa, Homo Sapiens
RLRLLEEQW

SEQ ID NO: 1397837 - protein, 9 aa, Homo Sapiens
FRSGSSFSW

SEQ ID NO: 1397838 - protein, 9 aa, Homo Sapiens
KPNECSECG

SEQ ID NO: 1397839 - protein, 9 aa, Homo Sapiens
GGGDGPWGR

SEQ ID NO: 1397840 - protein, 9 aa, Homo Sapiens
VAIHYINPR

SEQ ID NO: 1397841 - protein, 9 aa, Homo Sapiens
YEHLWTSLK

SEQ ID NO: 1397842 - protein, 9 aa, Homo Sapiens
HKKVTAVHK

SEQ ID NO: 1397843 - protein, 9 aa, Homo Sapiens
SRVQKNLPL

SEQ ID NO: 1397844 - protein, 9 aa, Homo Sapiens
YLVRFYLIL

SEQ ID NO: 1397845 - protein, 9 aa, Homo Sapiens
YTCDYVGGY

SEQ ID NO: 1397846 - protein, 9 aa, Homo Sapiens
KMIYLAHNA

SEQ ID NO: 1397847 - protein, 9 aa, Homo Sapiens
DIDRYRGPP

SEQ ID NO: 1397848 - protein, 9 aa, Homo Sapiens
PPLLEAFPL

SEQ ID NO: 1397849 - protein, 9 aa, Homo Sapiens
RQYGDRYIN

SEQ ID NO: 1397850 - protein, 9 aa, Homo Sapiens
SPCSAACRW

SEQ ID NO: 1397851 - protein, 9 aa, Homo Sapiens
ASTRASGPT

SEQ ID NO: 1397852 - protein, 9 aa, Homo Sapiens
YENFSCTWN

SEQ ID NO: 1397853 - protein, 9 aa, Homo Sapiens
TRGWRAQAL

SEQ ID NO: 1397854 - protein, 9 aa, Homo Sapiens
ANLSSSSTI

SEQ ID NO: 1397855 - protein, 9 aa, Homo Sapiens
ERAYGRLWR

SEQ ID NO: 1397856 - protein, 9 aa, Homo Sapiens
ASTTGASEP

SEQ ID NO: 1397857 - protein, 9 aa, Homo Sapiens
SLSLVDNDL

SEQ ID NO: 1397858 - protein, 9 aa, Homo Sapiens
RTISSCLGH

SEQ ID NO: 1397859 - protein, 9 aa, Homo Sapiens
VPRLDHFLT

SEQ ID NO: 1397860 - protein, 9 aa, Homo Sapiens
GWEDASVGW

SEQ ID NO: 1397861 - protein, 9 aa, Homo Sapiens
LEQQILSTY

SEQ ID NO: 1397862 - protein, 9 aa, Homo Sapiens
FCEPLWTIP

SEQ ID NO: 1397863 - protein, 9 aa, Homo Sapiens
GYGGAHPTP

SEQ ID NO: 1397864 - protein, 9 aa, Homo Sapiens
TSWRTKEQS

SEQ ID NO: 1397865 - protein, 9 aa, Homo Sapiens
LCSHFSRCS

SEQ ID NO: 1397866 - protein, 9 aa, Homo Sapiens
VKMHVKQEE

SEQ ID NO: 1397867 - protein, 9 aa, Homo Sapiens
SHWVLSPIE

SEQ ID NO: 1397868 - protein, 9 aa, Homo Sapiens
SIFRLYSRA

SEQ ID NO: 1397869 - protein, 9 aa, Homo Sapiens
TSGQPSDVG

SEQ ID NO: 1397870 - protein, 9 aa, Homo Sapiens
LGAVQILTL

SEQ ID NO: 1397871 - protein, 9 aa, Homo Sapiens
CLKFLSPQW

SEQ ID NO: 1397872 - protein, 9 aa, Homo Sapiens
TNLTPVQTL

SEQ ID NO: 1397873 - protein, 9 aa, Homo Sapiens
RICEAVPGA

SEQ ID NO: 1397874 - protein, 9 aa, Homo Sapiens
IIYPQRPKP

SEQ ID NO: 1397875 - protein, 9 aa, Homo Sapiens
LSPVCNGGM

SEQ ID NO: 1397876 - protein, 9 aa, Homo Sapiens
VPRYHVGCT

SEQ ID NO: 1397877 - protein, 9 aa, Homo Sapiens
GGMTPPKST

SEQ ID NO: 1397878 - protein, 9 aa, Homo Sapiens
SCLICDIDR

SEQ ID NO: 1397879 - protein, 9 aa, Homo Sapiens
GLTFPGWFF

SEQ ID NO: 1397880 - protein, 9 aa, Homo Sapiens
CACINSLKE

SEQ ID NO: 1397881 - protein, 9 aa, Homo Sapiens
SRASFNYLR

SEQ ID NO: 1397882 - protein, 9 aa, Homo Sapiens
SAQVEQLCQ

SEQ ID NO: 1397883 - protein, 9 aa, Homo Sapiens
DMLYFYAEQ

SEQ ID NO: 1397884 - protein, 9 aa, Homo Sapiens
HPAEEVILA

SEQ ID NO: 1397885 - protein, 9 aa, Homo Sapiens
RRSWEETPV

SEQ ID NO: 1397886 - protein, 9 aa, Homo Sapiens
DPGVCIFGY

SEQ ID NO: 1397887 - protein, 9 aa, Homo Sapiens
SSSAPTGAE

SEQ ID NO: 1397888 - protein, 9 aa, Homo Sapiens
PPRRKKPSK

SEQ ID NO: 1397889 - protein, 9 aa, Homo Sapiens
KMFLIQREL

SEQ ID NO: 1397890 - protein, 9 aa, Homo Sapiens
YYLPNLTHL

SEQ ID NO: 1397891 - protein, 9 aa, Homo Sapiens
ARRTAGSTA

SEQ ID NO: 1397892 - protein, 9 aa, Homo Sapiens
YSYPLPKFT

SEQ ID NO: 1397893 - protein, 9 aa, Homo Sapiens
VCKPGWQRL

SEQ ID NO: 1397894 - protein, 9 aa, Homo Sapiens
STASDHGCP

SEQ ID NO: 1397895 - protein, 9 aa, Homo Sapiens
ATTPPIGPS

SEQ ID NO: 1397896 - protein, 9 aa, Homo Sapiens
QTEKPVWSL

SEQ ID NO: 1397897 - protein, 9 aa, Homo Sapiens
KRKGECNHP

SEQ ID NO: 1397898 - protein, 9 aa, Homo Sapiens
WALILVTGQ

SEQ ID NO: 1397899 - protein, 9 aa, Homo Sapiens
KTRWQYYGT

SEQ ID NO: 1397900 - protein, 9 aa, Homo Sapiens
FRIHCQEVR

SEQ ID NO: 1397901 - protein, 9 aa, Homo Sapiens
SVGWLQWRR

SEQ ID NO: 1397902 - protein, 9 aa, Homo Sapiens
NGDVNARTA

SEQ ID NO: 1397903 - protein, 9 aa, Homo Sapiens
CRDVVLMQF

SEQ ID NO: 1397904 - protein, 9 aa, Homo Sapiens
EDKKNGIWE

SEQ ID NO: 1397905 - protein, 9 aa, Homo Sapiens
PPKITSPLN

SEQ ID NO: 1397906 - protein, 9 aa, Homo Sapiens
LRGFLLHQP

SEQ ID NO: 1397907 - protein, 9 aa, Homo Sapiens
HPRLCRQLA

SEQ ID NO: 1397908 - protein, 9 aa, Homo Sapiens
CRSEALYAF

SEQ ID NO: 1397909 - protein, 9 aa, Homo Sapiens
YASTSTSVS

SEQ ID NO: 1397910 - protein, 9 aa, Homo Sapiens
DLMEPTLQL

SEQ ID NO: 1397911 - protein, 9 aa, Homo Sapiens
PTAAKPSAR

SEQ ID NO: 1397912 - protein, 9 aa, Homo Sapiens
PGLKYVTYR

SEQ ID NO: 1397913 - protein, 9 aa, Homo Sapiens
LSAQLAGRR

SEQ ID NO: 1397914 - protein, 9 aa, Homo Sapiens
SGSGSGCGG

SEQ ID NO: 1397915 - protein, 9 aa, Homo Sapiens
AATTAAGAS

SEQ ID NO: 1397916 - protein, 9 aa, Homo Sapiens
GHLKPSGEQ

SEQ ID NO: 1397917 - protein, 9 aa, Homo Sapiens
SPRAAIWRR

SEQ ID NO: 1397918 - protein, 9 aa, Homo Sapiens
FSFGTRASS

SEQ ID NO: 1397919 - protein, 9 aa, Homo Sapiens
GATTPPIGP

SEQ ID NO: 1397920 - protein, 9 aa, Homo Sapiens
GPALKICAC

SEQ ID NO: 1397921 - protein, 9 aa, Homo Sapiens
GTLSFPLLI

SEQ ID NO: 1397922 - protein, 9 aa, Homo Sapiens
VTVLLLLPQ

SEQ ID NO: 1397923 - protein, 9 aa, Homo Sapiens
GVGVLPAPR

SEQ ID NO: 1397924 - protein, 9 aa, Homo Sapiens
VEDANPAGA

SEQ ID NO: 1397925 - protein, 9 aa, Homo Sapiens
FGTSYPHSA

SEQ ID NO: 1397926 - protein, 9 aa, Homo Sapiens
AWKSIFRLY

SEQ ID NO: 1397927 - protein, 9 aa, Homo Sapiens
FFGEQVSRR

SEQ ID NO: 1397928 - protein, 9 aa, Homo Sapiens
KPIHQHEDC

SEQ ID NO: 1397929 - protein, 9 aa, Homo Sapiens
QKLCNSQSY

SEQ ID NO: 1397930 - protein, 9 aa, Homo Sapiens
NKVLCFELE

SEQ ID NO: 1397931 - protein, 9 aa, Homo Sapiens
GTEEQMSVI

SEQ ID NO: 1397932 - protein, 9 aa, Homo Sapiens
DYPAVPRYH

SEQ ID NO: 1397933 - protein, 9 aa, Homo Sapiens
SPRMRHRMR

SEQ ID NO: 1397934 - protein, 9 aa, Homo Sapiens
PRLPAPHHQ

SEQ ID NO: 1397935 - protein, 9 aa, Homo Sapiens
PESQSQDPR

SEQ ID NO: 1397936 - protein, 9 aa, Homo Sapiens
AFNNLKNCI

SEQ ID NO: 1397937 - protein, 9 aa, Homo Sapiens
RGSHWSRSR

SEQ ID NO: 1397938 - protein, 9 aa, Homo Sapiens
KDGLMAHAF

SEQ ID NO: 1397939 - protein, 9 aa, Homo Sapiens
HQASTASDH

SEQ ID NO: 1397940 - protein, 9 aa, Homo Sapiens
EGDLQHALA

SEQ ID NO: 1397941 - protein, 9 aa, Homo Sapiens
HSGDWWGPS

SEQ ID NO: 1397942 - protein, 9 aa, Homo Sapiens
SLSSAEGGP

SEQ ID NO: 1397943 - protein, 9 aa, Homo Sapiens
SSPSSLPQD

SEQ ID NO: 1397944 - protein, 9 aa, Homo Sapiens
VTQVPLVSS

SEQ ID NO: 1397945 - protein, 9 aa, Homo Sapiens
AVWQDPLLG

SEQ ID NO: 1397946 - protein, 9 aa, Homo Sapiens
RQVAIVVKF

SEQ ID NO: 1397947 - protein, 9 aa, Homo Sapiens
DVASMYTQM

SEQ ID NO: 1397948 - protein, 9 aa, Homo Sapiens
GYIFGKHII

SEQ ID NO: 1397949 - protein, 9 aa, Homo Sapiens
IPGIRGALT

SEQ ID NO: 1397950 - protein, 9 aa, Homo Sapiens
RSPPTSCPP

SEQ ID NO: 1397951 - protein, 9 aa, Homo Sapiens
GHRLCVRPR

SEQ ID NO: 1397952 - protein, 9 aa, Homo Sapiens
LINSQVCPE

SEQ ID NO: 1397953 - protein, 9 aa, Homo Sapiens
PQKPNKRLR

SEQ ID NO: 1397954 - protein, 9 aa, Homo Sapiens
LEVKLKSVF

SEQ ID NO: 1397955 - protein, 9 aa, Homo Sapiens
NQRGSHWSR

SEQ ID NO: 1397956 - protein, 9 aa, Homo Sapiens
LPLCSHFSR

SEQ ID NO: 1397957 - protein, 9 aa, Homo Sapiens
MGGSLGGGA

SEQ ID NO: 1397958 - protein, 9 aa, Homo Sapiens
NTSHIMQYG

SEQ ID NO: 1397959 - protein, 9 aa, Homo Sapiens
GHGVGRIWL

SEQ ID NO: 1397960 - protein, 9 aa, Homo Sapiens
IAASAGPPA

SEQ ID NO: 1397961 - protein, 9 aa, Homo Sapiens
SRGSQRAVR

SEQ ID NO: 1397962 - protein, 9 aa, Homo Sapiens
EKAAPRPCW

SEQ ID NO: 1397963 - protein, 9 aa, Homo Sapiens
FLASSLLCS

SEQ ID NO: 1397964 - protein, 9 aa, Homo Sapiens
CPSQLRGSS

SEQ ID NO: 1397965 - protein, 9 aa, Homo Sapiens
TFLEHFLIS

SEQ ID NO: 1397966 - protein, 9 aa, Homo Sapiens
GVGLAASFA

SEQ ID NO: 1397967 - protein, 9 aa, Homo Sapiens
AVGARRRPS

SEQ ID NO: 1397968 - protein, 9 aa, Homo Sapiens
KCITECVRT

SEQ ID NO: 1397969 - protein, 9 aa, Homo Sapiens
TNFWGVPRK

SEQ ID NO: 1397970 - protein, 9 aa, Homo Sapiens
RADTYCHLY

SEQ ID NO: 1397971 - protein, 9 aa, Homo Sapiens
FWEEGRIQS

SEQ ID NO: 1397972 - protein, 9 aa, Homo Sapiens
SIIIVHQRT

SEQ ID NO: 1397973 - protein, 9 aa, Homo Sapiens
PRMRHRMRA

SEQ ID NO: 1397974 - protein, 9 aa, Homo Sapiens
TLEKKIKIG

SEQ ID NO: 1397975 - protein, 9 aa, Homo Sapiens
HVYIASTRL

SEQ ID NO: 1397976 - protein, 9 aa, Homo Sapiens
ARLQSQRPR

SEQ ID NO: 1397977 - protein, 9 aa, Homo Sapiens
NWRMKMKKM

SEQ ID NO: 1397978 - protein, 9 aa, Homo Sapiens
EAEERDQKR

SEQ ID NO: 1397979 - protein, 9 aa, Homo Sapiens
AGATAQIQR

SEQ ID NO: 1397980 - protein, 9 aa, Homo Sapiens
VAAGFLFLS

SEQ ID NO: 1397981 - protein, 9 aa, Homo Sapiens
DTSEVSLFT

SEQ ID NO: 1397982 - protein, 9 aa, Homo Sapiens
LLVFSFFFC

SEQ ID NO: 1397983 - protein, 9 aa, Homo Sapiens
LVAAGFLFL

SEQ ID NO: 1397984 - protein, 9 aa, Homo Sapiens
ACRAGGPAG

SEQ ID NO: 1397985 - protein, 9 aa, Homo Sapiens
PGYIFGKHI

SEQ ID NO: 1397986 - protein, 9 aa, Homo Sapiens
VTRVWHPAI

SEQ ID NO: 1397987 - protein, 9 aa, Homo Sapiens
LLHGRWRLD

SEQ ID NO: 1397988 - protein, 9 aa, Homo Sapiens
VCKTSGKAK

SEQ ID NO: 1397989 - protein, 9 aa, Homo Sapiens
KVVHIMTCC

SEQ ID NO: 1397990 - protein, 9 aa, Homo Sapiens
TSSPTARAT

SEQ ID NO: 1397991 - protein, 9 aa, Homo Sapiens
AASGCPRPL

SEQ ID NO: 1397992 - protein, 9 aa, Homo Sapiens
RLCCHHWNK

SEQ ID NO: 1397993 - protein, 9 aa, Homo Sapiens
MGGNRSICL

SEQ ID NO: 1397994 - protein, 9 aa, Homo Sapiens
IYPQRPKPS

SEQ ID NO: 1397995 - protein, 9 aa, Homo Sapiens
HACTALQNN

SEQ ID NO: 1397996 - protein, 9 aa, Homo Sapiens
EKISSWQVL

SEQ ID NO: 1397997 - protein, 9 aa, Homo Sapiens
TMAGPSASL

SEQ ID NO: 1397998 - protein, 9 aa, Homo Sapiens
KKMFLIQRE

SEQ ID NO: 1397999 - protein, 9 aa, Homo Sapiens
LNQRVQMVH

SEQ ID NO: 1398000 - protein, 9 aa, Homo Sapiens
YHHSRPVFD

SEQ ID NO: 1398001 - protein, 9 aa, Homo Sapiens
VIGASDILE

SEQ ID NO: 1398002 - protein, 9 aa, Homo Sapiens
VSSYRDRFP

SEQ ID NO: 1398003 - protein, 9 aa, Homo Sapiens
LGICVVKDL

SEQ ID NO: 1398004 - protein, 9 aa, Homo Sapiens
IDPPKICCP

SEQ ID NO: 1398005 - protein, 9 aa, Homo Sapiens
RRATRIACA

SEQ ID NO: 1398006 - protein, 9 aa, Homo Sapiens
KDAVDLRKA

SEQ ID NO: 1398007 - protein, 9 aa, Homo Sapiens
YVTYRNIRE

SEQ ID NO: 1398008 - protein, 9 aa, Homo Sapiens
TIAPVECPS

SEQ ID NO: 1398009 - protein, 9 aa, Homo Sapiens
WGRSRAGLI

SEQ ID NO: 1398010 - protein, 9 aa, Homo Sapiens
PRLDHFLTC

SEQ ID NO: 1398011 - protein, 9 aa, Homo Sapiens
STSAPTMAA

SEQ ID NO: 1398012 - protein, 9 aa, Homo Sapiens
EKKIKIGKK

SEQ ID NO: 1398013 - protein, 9 aa, Homo Sapiens
SGVTSVWAL

SEQ ID NO: 1398014 - protein, 9 aa, Homo Sapiens
RLRSRLPGP

SEQ ID NO: 1398015 - protein, 9 aa, Homo Sapiens
SQLPIPEDE

SEQ ID NO: 1398016 - protein, 9 aa, Homo Sapiens
PVKGITEKS

SEQ ID NO: 1398017 - protein, 9 aa, Homo Sapiens
LKIIRRRLP

SEQ ID NO: 1398018 - protein, 9 aa, Homo Sapiens
VGARKQEEE

SEQ ID NO: 1398019 - protein, 9 aa, Homo Sapiens
VSCSNIFLN

SEQ ID NO: 1398020 - protein, 9 aa, Homo Sapiens
KHTFSPVIE

SEQ ID NO: 1398021 - protein, 9 aa, Homo Sapiens
VLATGLHLH

SEQ ID NO: 1398022 - protein, 9 aa, Homo Sapiens
MRMPSAGTM

SEQ ID NO: 1398023 - protein, 9 aa, Homo Sapiens
HDIRREEAG

SEQ ID NO: 1398024 - protein, 9 aa, Homo Sapiens
ETSDPSEEL

SEQ ID NO: 1398025 - protein, 9 aa, Homo Sapiens
PMKTAGKPW

SEQ ID NO: 1398026 - protein, 9 aa, Homo Sapiens
TCTLFSWHT

SEQ ID NO: 1398027 - protein, 9 aa, Homo Sapiens
LVDTSGLWF

SEQ ID NO: 1398028 - protein, 9 aa, Homo Sapiens
RLPGPPTLG

SEQ ID NO: 1398029 - protein, 9 aa, Homo Sapiens
IGGSGRGSN

SEQ ID NO: 1398030 - protein, 9 aa, Homo Sapiens
TRFAAYIFG

SEQ ID NO: 1398031 - protein, 9 aa, Homo Sapiens
DEVVAERLE

SEQ ID NO: 1398032 - protein, 9 aa, Homo Sapiens
MNSFLVALT

SEQ ID NO: 1398033 - protein, 9 aa, Homo Sapiens
RFQGPAPPP

SEQ ID NO: 1398034 - protein, 9 aa, Homo Sapiens
DSLGAKGRG

SEQ ID NO: 1398035 - protein, 9 aa, Homo Sapiens
GRPWCRESL

SEQ ID NO: 1398036 - protein, 9 aa, Homo Sapiens
YVAIFVMCW

SEQ ID NO: 1398037 - protein, 9 aa, Homo Sapiens
VAVICDSCT

SEQ ID NO: 1398038 - protein, 9 aa, Homo Sapiens
WVLSPIECT

SEQ ID NO: 1398039 - protein, 9 aa, Homo Sapiens
SNIFLNFNP

SEQ ID NO: 1398040 - protein, 9 aa, Homo Sapiens
HLLLMKRPS

SEQ ID NO: 1398041 - protein, 9 aa, Homo Sapiens
KAGQAGHHS

SEQ ID NO: 1398042 - protein, 9 aa, Homo Sapiens
ENAALPTAN

SEQ ID NO: 1398043 - protein, 9 aa, Homo Sapiens
HPAIPAHPA

SEQ ID NO: 1398044 - protein, 9 aa, Homo Sapiens
TVSQDHTVR

SEQ ID NO: 1398045 - protein, 9 aa, Homo Sapiens
IWFQNWRMK

SEQ ID NO: 1398046 - protein, 9 aa, Homo Sapiens
QIQRPIQVQ

SEQ ID NO: 1398047 - protein, 9 aa, Homo Sapiens
EEDASDVLQ

SEQ ID NO: 1398048 - protein, 9 aa, Homo Sapiens
QVETQSLAA

SEQ ID NO: 1398049 - protein, 9 aa, Homo Sapiens
PTSAPTAAK

SEQ ID NO: 1398050 - protein, 9 aa, Homo Sapiens
LHHSMTRFW

SEQ ID NO: 1398051 - protein, 9 aa, Homo Sapiens
PEQLPQHAL

SEQ ID NO: 1398052 - protein, 9 aa, Homo Sapiens
HWVLSPIEC

SEQ ID NO: 1398053 - protein, 9 aa, Homo Sapiens
RCGFATRGW

SEQ ID NO: 1398054 - protein, 9 aa, Homo Sapiens
SRARSVEQG

SEQ ID NO: 1398055 - protein, 9 aa, Homo Sapiens
QLCHKAQFV

SEQ ID NO: 1398056 - protein, 9 aa, Homo Sapiens
PIQVLTYEW

SEQ ID NO: 1398057 - protein, 9 aa, Homo Sapiens
KSRKAYLPQ

SEQ ID NO: 1398058 - protein, 9 aa, Homo Sapiens
HFQDVRGQL

SEQ ID NO: 1398059 - protein, 9 aa, Homo Sapiens
RARGGTTIG

SEQ ID NO: 1398060 - protein, 9 aa, Homo Sapiens
NCIYPLSMC

SEQ ID NO: 1398061 - protein, 9 aa, Homo Sapiens
NGAAQMGTV

SEQ ID NO: 1398062 - protein, 9 aa, Homo Sapiens
EVKLKSVFA

SEQ ID NO: 1398063 - protein, 9 aa, Homo Sapiens
PLRPLLQLR

SEQ ID NO: 1398064 - protein, 9 aa, Homo Sapiens
ADTYCHLYS

SEQ ID NO: 1398065 - protein, 9 aa, Homo Sapiens
QHALAQAIA

SEQ ID NO: 1398066 - protein, 9 aa, Homo Sapiens
PCSRRAPSC

SEQ ID NO: 1398067 - protein, 9 aa, Homo Sapiens
EAWGARRGV

SEQ ID NO: 1398068 - protein, 9 aa, Homo Sapiens
YFEVSGIRP

SEQ ID NO: 1398069 - protein, 9 aa, Homo Sapiens
PNVNMESSR

SEQ ID NO: 1398070 - protein, 9 aa, Homo Sapiens
QGLVAGVGL

SEQ ID NO: 1398071 - protein, 9 aa, Homo Sapiens
PRRKKPSKR

SEQ ID NO: 1398072 - protein, 9 aa, Homo Sapiens
VIVIVLYFS

SEQ ID NO: 1398073 - protein, 9 aa, Homo Sapiens
NCCRLWCFP

SEQ ID NO: 1398074 - protein, 9 aa, Homo Sapiens
AASQDTALA

SEQ ID NO: 1398075 - protein, 9 aa, Homo Sapiens
QTGANSLSS

SEQ ID NO: 1398076 - protein, 9 aa, Homo Sapiens
QQILHQNLV

SEQ ID NO: 1398077 - protein, 9 aa, Homo Sapiens
GTHAFGYGV

SEQ ID NO: 1398078 - protein, 9 aa, Homo Sapiens
WMSPASSPA

SEQ ID NO: 1398079 - protein, 9 aa, Homo Sapiens
HWSRSRGLP

SEQ ID NO: 1398080 - protein, 9 aa, Homo Sapiens
ETPSSEPKE

SEQ ID NO: 1398081 - protein, 9 aa, Homo Sapiens
GQGLVGMTP

SEQ ID NO: 1398082 - protein, 9 aa, Homo Sapiens
ALLAGSRTP

SEQ ID NO: 1398083 - protein, 9 aa, Homo Sapiens
PRPHGLQSG

SEQ ID NO: 1398084 - protein, 9 aa, Homo Sapiens
GARKQEEEE

SEQ ID NO: 1398085 - protein, 9 aa, Homo Sapiens
EEIEADSLS

SEQ ID NO: 1398086 - protein, 9 aa, Homo Sapiens
GPSSSAPTG

SEQ ID NO: 1398087 - protein, 9 aa, Homo Sapiens
MHTDVIHSV

SEQ ID NO: 1398088 - protein, 9 aa, Homo Sapiens
PVKVLQKGK

SEQ ID NO: 1398089 - protein, 9 aa, Homo Sapiens
QFSSGEKIS

SEQ ID NO: 1398090 - protein, 9 aa, Homo Sapiens
KTSGKAKSH

SEQ ID NO: 1398091 - protein, 9 aa, Homo Sapiens
GRLCCHHWN

SEQ ID NO: 1398092 - protein, 9 aa, Homo Sapiens
QPFLRVLES

SEQ ID NO: 1398093 - protein, 9 aa, Homo Sapiens
TEASLRRMR

SEQ ID NO: 1398094 - protein, 9 aa, Homo Sapiens
QEKERRERA

SEQ ID NO: 1398095 - protein, 9 aa, Homo Sapiens
KDAKEVEHT

SEQ ID NO: 1398096 - protein, 9 aa, Homo Sapiens
HSSVLATGL

SEQ ID NO: 1398097 - protein, 9 aa, Homo Sapiens
VHEWNDGRD

SEQ ID NO: 1398098 - protein, 9 aa, Homo Sapiens
SLSDKSSHS

SEQ ID NO: 1398099 - protein, 9 aa, Homo Sapiens
TTGYQSIKR

SEQ ID NO: 1398100 - protein, 9 aa, Homo Sapiens
DLAPGLITI

SEQ ID NO: 1398101 - protein, 9 aa, Homo Sapiens
LSTLKPPAP

SEQ ID NO: 1398102 - protein, 9 aa, Homo Sapiens
HPLPKRQEL

SEQ ID NO: 1398103 - protein, 9 aa, Homo Sapiens
MTPRDLGTV

SEQ ID NO: 1398104 - protein, 9 aa, Homo Sapiens
AEVHAQYEE

SEQ ID NO: 1398105 - protein, 9 aa, Homo Sapiens
GMTPRDLGT

SEQ ID NO: 1398106 - protein, 9 aa, Homo Sapiens
KSAGYRSCA

SEQ ID NO: 1398107 - protein, 9 aa, Homo Sapiens
SSGLFLLVA

SEQ ID NO: 1398108 - protein, 9 aa, Homo Sapiens
SVEQGCLKR

SEQ ID NO: 1398109 - protein, 9 aa, Homo Sapiens
PSPARSAAA

SEQ ID NO: 1398110 - protein, 9 aa, Homo Sapiens
AWGARRGVK

SEQ ID NO: 1398111 - protein, 9 aa, Homo Sapiens
IMGDGLYNF

SEQ ID NO: 1398112 - protein, 9 aa, Homo Sapiens
LHRLLQEQH

SEQ ID NO: 1398113 - protein, 9 aa, Homo Sapiens
TNPAVTATS

SEQ ID NO: 1398114 - protein, 9 aa, Homo Sapiens
MSFGATSPV

SEQ ID NO: 1398115 - protein, 9 aa, Homo Sapiens
QDVCQGSPW

SEQ ID NO: 1398116 - protein, 9 aa, Homo Sapiens
PYVMKTGSD

SEQ ID NO: 1398117 - protein, 9 aa, Homo Sapiens
FVACLVLTD

SEQ ID NO: 1398118 - protein, 9 aa, Homo Sapiens
GYPGPAARG

SEQ ID NO: 1398119 - protein, 9 aa, Homo Sapiens
PQEEEEEDE

SEQ ID NO: 1398120 - protein, 9 aa, Homo Sapiens
LKASEHACT

SEQ ID NO: 1398121 - protein, 9 aa, Homo Sapiens
TMNSFLVAL

SEQ ID NO: 1398122 - protein, 9 aa, Homo Sapiens
EMVIGASDI

SEQ ID NO: 1398123 - protein, 9 aa, Homo Sapiens
AAKPSARSP

SEQ ID NO: 1398124 - protein, 9 aa, Homo Sapiens
RPQWMHACG

SEQ ID NO: 1398125 - protein, 9 aa, Homo Sapiens
MATMRTQTA

SEQ ID NO: 1398126 - protein, 9 aa, Homo Sapiens
SGWSASCGP

SEQ ID NO: 1398127 - protein, 9 aa, Homo Sapiens
ARSQLPWPA

SEQ ID NO: 1398128 - protein, 9 aa, Homo Sapiens
CTLFSWHTP

SEQ ID NO: 1398129 - protein, 9 aa, Homo Sapiens
LLSGRVAVV

SEQ ID NO: 1398130 - protein, 9 aa, Homo Sapiens
FSVTTWASL

SEQ ID NO: 1398131 - protein, 9 aa, Homo Sapiens
GPVLLSRWT

SEQ ID NO: 1398132 - protein, 9 aa, Homo Sapiens
SESHISSAR

SEQ ID NO: 1398133 - protein, 9 aa, Homo Sapiens
ASDHGCPSQ

SEQ ID NO: 1398134 - protein, 9 aa, Homo Sapiens
SLYGKKLVK

SEQ ID NO: 1398135 - protein, 9 aa, Homo Sapiens
ENLLHNHYG

SEQ ID NO: 1398136 - protein, 9 aa, Homo Sapiens
GSPSGGAEG

SEQ ID NO: 1398137 - protein, 9 aa, Homo Sapiens
GDAHSSGLT

SEQ ID NO: 1398138 - protein, 9 aa, Homo Sapiens
PHLLYTLGA

SEQ ID NO: 1398139 - protein, 9 aa, Homo Sapiens
CIYPLSMCI

SEQ ID NO: 1398140 - protein, 9 aa, Homo Sapiens
SSPILNAEE

SEQ ID NO: 1398141 - protein, 9 aa, Homo Sapiens
VTIYSPDGV

SEQ ID NO: 1398142 - protein, 9 aa, Homo Sapiens
SQHFTGPKA

SEQ ID NO: 1398143 - protein, 9 aa, Homo Sapiens
ELIELRKKI

SEQ ID NO: 1398144 - protein, 9 aa, Homo Sapiens
QLRKPRRRR

SEQ ID NO: 1398145 - protein, 9 aa, Homo Sapiens
TGVCHLCLE

SEQ ID NO: 1398146 - protein, 9 aa, Homo Sapiens
FIPSQPPTL

SEQ ID NO: 1398147 - protein, 9 aa, Homo Sapiens
GRYVCENCK

SEQ ID NO: 1398148 - protein, 9 aa, Homo Sapiens
STLKVATDL

SEQ ID NO: 1398149 - protein, 9 aa, Homo Sapiens
AARKPHSPP

SEQ ID NO: 1398150 - protein, 9 aa, Homo Sapiens
ICACINSLK

SEQ ID NO: 1398151 - protein, 9 aa, Homo Sapiens
KVPSAECSV

SEQ ID NO: 1398152 - protein, 9 aa, Homo Sapiens
MSQEYSYQD

SEQ ID NO: 1398153 - protein, 9 aa, Homo Sapiens
DLGTVAGAT

SEQ ID NO: 1398154 - protein, 9 aa, Homo Sapiens
EAAKLYDIA

SEQ ID NO: 1398155 - protein, 9 aa, Homo Sapiens
WPCWLLQFF

SEQ ID NO: 1398156 - protein, 9 aa, Homo Sapiens
AAACIHMMP

SEQ ID NO: 1398157 - protein, 9 aa, Homo Sapiens
LVIVGHGHE

SEQ ID NO: 1398158 - protein, 9 aa, Homo Sapiens
RHRMRARLQ

SEQ ID NO: 1398159 - protein, 9 aa, Homo Sapiens
AGWPCWLLQ

SEQ ID NO: 1398160 - protein, 9 aa, Homo Sapiens
PRHHPRSRP

SEQ ID NO: 1398161 - protein, 9 aa, Homo Sapiens
PVVDKGKQE

SEQ ID NO: 1398162 - protein, 9 aa, Homo Sapiens
KSHCLDHIN

SEQ ID NO: 1398163 - protein, 9 aa, Homo Sapiens
ALQASYTPS

SEQ ID NO: 1398164 - protein, 9 aa, Homo Sapiens
MHLCQYELL

SEQ ID NO: 1398165 - protein, 9 aa, Homo Sapiens
QALKDEEEK

SEQ ID NO: 1398166 - protein, 9 aa, Homo Sapiens
PFLASSLLC

SEQ ID NO: 1398167 - protein, 9 aa, Homo Sapiens
PPAASGCPR

SEQ ID NO: 1398168 - protein, 9 aa, Homo Sapiens
PVWSLLNWT

SEQ ID NO: 1398169 - protein, 9 aa, Homo Sapiens
RTPIPTGSR

SEQ ID NO: 1398170 - protein, 9 aa, Homo Sapiens
RPTAIRQTL

SEQ ID NO: 1398171 - protein, 9 aa, Homo Sapiens
RLCRAHPML

SEQ ID NO: 1398172 - protein, 9 aa, Homo Sapiens
LFLLLWRLF

SEQ ID NO: 1398173 - protein, 9 aa, Homo Sapiens
FMYHHSRPV

SEQ ID NO: 1398174 - protein, 9 aa, Homo Sapiens
TDPNSRICG

SEQ ID NO: 1398175 - protein, 9 aa, Homo Sapiens
PTGGGSVPW

SEQ ID NO: 1398176 - protein, 9 aa, Homo Sapiens
ANTESSRQT

SEQ ID NO: 1398177 - protein, 9 aa, Homo Sapiens
STYLIFCDN

SEQ ID NO: 1398178 - protein, 9 aa, Homo Sapiens
SGSGCGGGS

SEQ ID NO: 1398179 - protein, 9 aa, Homo Sapiens
VLWMSPASS

SEQ ID NO: 1398180 - protein, 9 aa, Homo Sapiens
VLVRDMLYF

SEQ ID NO: 1398181 - protein, 9 aa, Homo Sapiens
SVRPPVTTS

SEQ ID NO: 1398182 - protein, 9 aa, Homo Sapiens
GGLYNICSI

SEQ ID NO: 1398183 - protein, 9 aa, Homo Sapiens
FPEYMFNSN

SEQ ID NO: 1398184 - protein, 9 aa, Homo Sapiens
KPPSRHVGG

SEQ ID NO: 1398185 - protein, 9 aa, Homo Sapiens
SSSSTILFW

SEQ ID NO: 1398186 - protein, 9 aa, Homo Sapiens
RAVRGTSPS

SEQ ID NO: 1398187 - protein, 9 aa, Homo Sapiens
SVNTGELMA

SEQ ID NO: 1398188 - protein, 9 aa, Homo Sapiens
QYICDRGFV

SEQ ID NO: 1398189 - protein, 9 aa, Homo Sapiens
NPDHIRVQA

SEQ ID NO: 1398190 - protein, 9 aa, Homo Sapiens
ARVVYASTT

SEQ ID NO: 1398191 - protein, 9 aa, Homo Sapiens
QMWVMSRAC

SEQ ID NO: 1398192 - protein, 9 aa, Homo Sapiens
HRSPPTSCP

SEQ ID NO: 1398193 - protein, 9 aa, Homo Sapiens
GPSASLHPA

SEQ ID NO: 1398194 - protein, 9 aa, Homo Sapiens
PRCWKYTTE

SEQ ID NO: 1398195 - protein, 9 aa, Homo Sapiens
TRKNGGGLK

SEQ ID NO: 1398196 - protein, 9 aa, Homo Sapiens
EILPDEIYH

SEQ ID NO: 1398197 - protein, 9 aa, Homo Sapiens
SAPNGTTGP

SEQ ID NO: 1398198 - protein, 9 aa, Homo Sapiens
CPWLPQGHQ

SEQ ID NO: 1398199 - protein, 9 aa, Homo Sapiens
EIEADSLSD

SEQ ID NO: 1398200 - protein, 9 aa, Homo Sapiens
HGLQSGCGQ

SEQ ID NO: 1398201 - protein, 9 aa, Homo Sapiens
LGSPLLSGA

SEQ ID NO: 1398202 - protein, 9 aa, Homo Sapiens
WQDPLLGSS

SEQ ID NO: 1398203 - protein, 9 aa, Homo Sapiens
RLLEEQWGA

SEQ ID NO: 1398204 - protein, 9 aa, Homo Sapiens
KKETKFQLI

SEQ ID NO: 1398205 - protein, 9 aa, Homo Sapiens
FLDPDIGGS

SEQ ID NO: 1398206 - protein, 9 aa, Homo Sapiens
MVIVIVLYF

SEQ ID NO: 1398207 - protein, 9 aa, Homo Sapiens
SLRNCIPAP

SEQ ID NO: 1398208 - protein, 9 aa, Homo Sapiens
GQFMYHHSR

SEQ ID NO: 1398209 - protein, 9 aa, Homo Sapiens
TTSSPRRSP

SEQ ID NO: 1398210 - protein, 9 aa, Homo Sapiens
PEQVHKVCV

SEQ ID NO: 1398211 - protein, 9 aa, Homo Sapiens
CSWISSQTR

SEQ ID NO: 1398212 - protein, 9 aa, Homo Sapiens
QPEVTQVPL

SEQ ID NO: 1398213 - protein, 9 aa, Homo Sapiens
HRPGLGTVG

SEQ ID NO: 1398214 - protein, 9 aa, Homo Sapiens
RAVLVERGP

SEQ ID NO: 1398215 - protein, 9 aa, Homo Sapiens
RAGGPAGWA

SEQ ID NO: 1398216 - protein, 9 aa, Homo Sapiens
HPASGRASR

SEQ ID NO: 1398217 - protein, 9 aa, Homo Sapiens
ASWQPACGA

SEQ ID NO: 1398218 - protein, 9 aa, Homo Sapiens
YDAQLYKGI

SEQ ID NO: 1398219 - protein, 9 aa, Homo Sapiens
VEKTSKRDG

SEQ ID NO: 1398220 - protein, 9 aa, Homo Sapiens
KKRSKKVST

SEQ ID NO: 1398221 - protein, 9 aa, Homo Sapiens
PYCIIAAVK

SEQ ID NO: 1398222 - protein, 9 aa, Homo Sapiens
KPSGEQIPG

SEQ ID NO: 1398223 - protein, 9 aa, Homo Sapiens
WWQENLSKV

SEQ ID NO: 1398224 - protein, 9 aa, Homo Sapiens
RRLRSRLPG

SEQ ID NO: 1398225 - protein, 9 aa, Homo Sapiens
ASLRATVPR

SEQ ID NO: 1398226 - protein, 9 aa, Homo Sapiens
LVFSFFFCL

SEQ ID NO: 1398227 - protein, 9 aa, Homo Sapiens
ERRPRKKPP

SEQ ID NO: 1398228 - protein, 9 aa, Homo Sapiens
EEGIYRWPG

SEQ ID NO: 1398229 - protein, 9 aa, Homo Sapiens
VRRGGCPGL

SEQ ID NO: 1398230 - protein, 9 aa, Homo Sapiens
LSTYQMTPQ

SEQ ID NO: 1398231 - protein, 9 aa, Homo Sapiens
DHQWNPPLV

SEQ ID NO: 1398232 - protein, 9 aa, Homo Sapiens
HLCLEPPDT

SEQ ID NO: 1398233 - protein, 9 aa, Homo Sapiens
LGVMVARCK

SEQ ID NO: 1398234 - protein, 9 aa, Homo Sapiens
LRGHPSAFN

SEQ ID NO: 1398235 - protein, 9 aa, Homo Sapiens
LNGNSVTTA

SEQ ID NO: 1398236 - protein, 9 aa, Homo Sapiens
QAVIADGKY

SEQ ID NO: 1398237 - protein, 9 aa, Homo Sapiens
TESSDTLCP

SEQ ID NO: 1398238 - protein, 9 aa, Homo Sapiens
EVDNGAAQM

SEQ ID NO: 1398239 - protein, 9 aa, Homo Sapiens
GCVFIIKSY

SEQ ID NO: 1398240 - protein, 9 aa, Homo Sapiens
SLKVPSAEC

SEQ ID NO: 1398241 - protein, 9 aa, Homo Sapiens
MTTNTYISL

SEQ ID NO: 1398242 - protein, 9 aa, Homo Sapiens
ACGGAGGGG

SEQ ID NO: 1398243 - protein, 9 aa, Homo Sapiens
MCYTASIMT

SEQ ID NO: 1398244 - protein, 9 aa, Homo Sapiens
PIGPSCVPT

SEQ ID NO: 1398245 - protein, 9 aa, Homo Sapiens
FSCTWNPSQ

SEQ ID NO: 1398246 - protein, 9 aa, Homo Sapiens
PRGAGSYII

SEQ ID NO: 1398247 - protein, 9 aa, Homo Sapiens
AVQAVQTMN

SEQ ID NO: 1398248 - protein, 9 aa, Homo Sapiens
LKEDKKIEE

SEQ ID NO: 1398249 - protein, 9 aa, Homo Sapiens
QSLHQELYV

SEQ ID NO: 1398250 - protein, 9 aa, Homo Sapiens
VLPEYKLQV

SEQ ID NO: 1398251 - protein, 9 aa, Homo Sapiens
AEDYPFGPV

SEQ ID NO: 1398252 - protein, 9 aa, Homo Sapiens
ALRPPAAVR

SEQ ID NO: 1398253 - protein, 9 aa, Homo Sapiens
PLRGFLLHQ

SEQ ID NO: 1398254 - protein, 9 aa, Homo Sapiens
LLAYGESQR

SEQ ID NO: 1398255 - protein, 9 aa, Homo Sapiens
HPEPLDGAV

SEQ ID NO: 1398256 - protein, 9 aa, Homo Sapiens
NHYGGKEYW

SEQ ID NO: 1398257 - protein, 9 aa, Homo Sapiens
WWGQKTKVF

SEQ ID NO: 1398258 - protein, 9 aa, Homo Sapiens
RLPKPAKSC

SEQ ID NO: 1398259 - protein, 9 aa, Homo Sapiens
SVLLSSVLR

SEQ ID NO: 1398260 - protein, 9 aa, Homo Sapiens
PENPEQAVG

SEQ ID NO: 1398261 - protein, 9 aa, Homo Sapiens
TGQMWVMSR

SEQ ID NO: 1398262 - protein, 9 aa, Homo Sapiens
HRLCVRPRE

SEQ ID NO: 1398263 - protein, 9 aa, Homo Sapiens
SSGYSIIGS

SEQ ID NO: 1398264 - protein, 9 aa, Homo Sapiens
RASGPTPVP

SEQ ID NO: 1398265 - protein, 9 aa, Homo Sapiens
HVGSSFTVL

SEQ ID NO: 1398266 - protein, 9 aa, Homo Sapiens
MEGKAFLPE

SEQ ID NO: 1398267 - protein, 9 aa, Homo Sapiens
AIHYINPRT

SEQ ID NO: 1398268 - protein, 9 aa, Homo Sapiens
ERYRPNMEG

SEQ ID NO: 1398269 - protein, 9 aa, Homo Sapiens
PEESASPAV

SEQ ID NO: 1398270 - protein, 9 aa, Homo Sapiens
GGSGRGSNS

SEQ ID NO: 1398271 - protein, 9 aa, Homo Sapiens
GPSCVPTAA

SEQ ID NO: 1398272 - protein, 9 aa, Homo Sapiens
RMHWRAWWQ

SEQ ID NO: 1398273 - protein, 9 aa, Homo Sapiens
MGAAVFFGY

SEQ ID NO: 1398274 - protein, 9 aa, Homo Sapiens
SVNFLMVFI

SEQ ID NO: 1398275 - protein, 9 aa, Homo Sapiens
LITIGASPT

SEQ ID NO: 1398276 - protein, 9 aa, Homo Sapiens
EWDCPLDSK

SEQ ID NO: 1398277 - protein, 9 aa, Homo Sapiens
QRSAEQSPV

SEQ ID NO: 1398278 - protein, 9 aa, Homo Sapiens
NSVTTATQT

SEQ ID NO: 1398279 - protein, 9 aa, Homo Sapiens
GLWFTSRVQ

SEQ ID NO: 1398280 - protein, 9 aa, Homo Sapiens
RKFHFEELL

SEQ ID NO: 1398281 - protein, 9 aa, Homo Sapiens
AGAASRSWA

SEQ ID NO: 1398282 - protein, 9 aa, Homo Sapiens
TGASTPARS

SEQ ID NO: 1398283 - protein, 9 aa, Homo Sapiens
PHSAWCVYQ

SEQ ID NO: 1398284 - protein, 9 aa, Homo Sapiens
GGNARRTAG

SEQ ID NO: 1398285 - protein, 9 aa, Homo Sapiens
FNDNEKETM

SEQ ID NO: 1398286 - protein, 9 aa, Homo Sapiens
QCFQMMEGK

SEQ ID NO: 1398287 - protein, 9 aa, Homo Sapiens
DRHFGWTPR

SEQ ID NO: 1398288 - protein, 9 aa, Homo Sapiens
KVSTRKNGG

SEQ ID NO: 1398289 - protein, 9 aa, Homo Sapiens
TGVPGGHAQ

SEQ ID NO: 1398290 - protein, 9 aa, Homo Sapiens
GEEAALQIP

SEQ ID NO: 1398291 - protein, 9 aa, Homo Sapiens
LINKITPPF

SEQ ID NO: 1398292 - protein, 9 aa, Homo Sapiens
NCFFTSLFV

SEQ ID NO: 1398293 - protein, 9 aa, Homo Sapiens
ILICDQLFL

SEQ ID NO: 1398294 - protein, 9 aa, Homo Sapiens
EETPVAESP

SEQ ID NO: 1398295 - protein, 9 aa, Homo Sapiens
EQWGALYRL

SEQ ID NO: 1398296 - protein, 9 aa, Homo Sapiens
NMDHSISIL

SEQ ID NO: 1398297 - protein, 9 aa, Homo Sapiens
EESWEKSFV

SEQ ID NO: 1398298 - protein, 9 aa, Homo Sapiens
RPRQPSQQL

SEQ ID NO: 1398299 - protein, 9 aa, Homo Sapiens
AAASPRAAI

SEQ ID NO: 1398300 - protein, 9 aa, Homo Sapiens
ISLRVGLRH

SEQ ID NO: 1398301 - protein, 9 aa, Homo Sapiens
TWCRTGAST

SEQ ID NO: 1398302 - protein, 9 aa, Homo Sapiens
PELRSSENS

SEQ ID NO: 1398303 - protein, 9 aa, Homo Sapiens
VIFVQNSGW

SEQ ID NO: 1398304 - protein, 9 aa, Homo Sapiens
ESHSHWVLS

SEQ ID NO: 1398305 - protein, 9 aa, Homo Sapiens
TTCLFCGNI

SEQ ID NO: 1398306 - protein, 9 aa, Homo Sapiens
AIAVQAGDG

SEQ ID NO: 1398307 - protein, 9 aa, Homo Sapiens
NIFLNFNPD

SEQ ID NO: 1398308 - protein, 9 aa, Homo Sapiens
DGKIIVGDA

SEQ ID NO: 1398309 - protein, 9 aa, Homo Sapiens
YINSLTILD

SEQ ID NO: 1398310 - protein, 9 aa, Homo Sapiens
PRKMILSQL

SEQ ID NO: 1398311 - protein, 9 aa, Homo Sapiens
CDRGFVLMG

SEQ ID NO: 1398312 - protein, 9 aa, Homo Sapiens
TQTAATLQP

SEQ ID NO: 1398313 - protein, 9 aa, Homo Sapiens
VGVLPAPRM

SEQ ID NO: 1398314 - protein, 9 aa, Homo Sapiens
PRYHVGCTN

SEQ ID NO: 1398315 - protein, 9 aa, Homo Sapiens
AFNDNEKET

SEQ ID NO: 1398316 - protein, 9 aa, Homo Sapiens
LSSVLRSWQ

SEQ ID NO: 1398317 - protein, 9 aa, Homo Sapiens
PSDVGSRPL

SEQ ID NO: 1398318 - protein, 9 aa, Homo Sapiens
DVGWGDNCE

SEQ ID NO: 1398319 - protein, 9 aa, Homo Sapiens
PADDEDGLE

SEQ ID NO: 1398320 - protein, 9 aa, Homo Sapiens
RKPRRRRGS

SEQ ID NO: 1398321 - protein, 9 aa, Homo Sapiens
TCGTMFTNS

SEQ ID NO: 1398322 - protein, 9 aa, Homo Sapiens
LHIRGDDSG

SEQ ID NO: 1398323 - protein, 9 aa, Homo Sapiens
QDSTFEENM

SEQ ID NO: 1398324 - protein, 9 aa, Homo Sapiens
DVGDCPKRP

SEQ ID NO: 1398325 - protein, 9 aa, Homo Sapiens
PVPACWISS

SEQ ID NO: 1398326 - protein, 9 aa, Homo Sapiens
VVMQRELTA

SEQ ID NO: 1398327 - protein, 9 aa, Homo Sapiens
WQSITMGTA

SEQ ID NO: 1398328 - protein, 9 aa, Homo Sapiens
GSPGSLPKS

SEQ ID NO: 1398329 - protein, 9 aa, Homo Sapiens
HSQPVKCGR

SEQ ID NO: 1398330 - protein, 9 aa, Homo Sapiens
DGHGRLVIV

SEQ ID NO: 1398331 - protein, 9 aa, Homo Sapiens
VIDLMEPTL

SEQ ID NO: 1398332 - protein, 9 aa, Homo Sapiens
DDLINKITP

SEQ ID NO: 1398333 - protein, 9 aa, Homo Sapiens
DRDPMLSPS

SEQ ID NO: 1398334 - protein, 9 aa, Homo Sapiens
KKFAEQDVK

SEQ ID NO: 1398335 - protein, 9 aa, Homo Sapiens
RHSVLRGCL

SEQ ID NO: 1398336 - protein, 9 aa, Homo Sapiens
PGRPLRPLL

SEQ ID NO: 1398337 - protein, 9 aa, Homo Sapiens
PGDCPRTMA

SEQ ID NO: 1398338 - protein, 9 aa, Homo Sapiens
SLLYEEAHY

SEQ ID NO: 1398339 - protein, 9 aa, Homo Sapiens
SPVPPVLER

SEQ ID NO: 1398340 - protein, 9 aa, Homo Sapiens
MYQVKTYHG

SEQ ID NO: 1398341 - protein, 9 aa, Homo Sapiens
AVNKGQPII

SEQ ID NO: 1398342 - protein, 9 aa, Homo Sapiens
SSVCVLPTR

SEQ ID NO: 1398343 - protein, 9 aa, Homo Sapiens
CRCKPNFFV

SEQ ID NO: 1398344 - protein, 9 aa, Homo Sapiens
GTVFPLCPW

SEQ ID NO: 1398345 - protein, 9 aa, Homo Sapiens
YQSIKRKFH

SEQ ID NO: 1398346 - protein, 9 aa, Homo Sapiens
PLLEAFPLP

SEQ ID NO: 1398347 - protein, 9 aa, Homo Sapiens
SKEDLLVSW

SEQ ID NO: 1398348 - protein, 9 aa, Homo Sapiens
RGEQESQGG

SEQ ID NO: 1398349 - protein, 9 aa, Homo Sapiens
GLDMRPFLA

SEQ ID NO: 1398350 - protein, 9 aa, Homo Sapiens
MRPKKCPLL

SEQ ID NO: 1398351 - protein, 9 aa, Homo Sapiens
GAAVFFGYT

SEQ ID NO: 1398352 - protein, 9 aa, Homo Sapiens
AWPRGEQES

SEQ ID NO: 1398353 - protein, 9 aa, Homo Sapiens
CFELERTIS

SEQ ID NO: 1398354 - protein, 9 aa, Homo Sapiens
QPPHRPGLG

SEQ ID NO: 1398355 - protein, 9 aa, Homo Sapiens
DAGDQPGAD

SEQ ID NO: 1398356 - protein, 9 aa, Homo Sapiens
SVCVLPTRI

SEQ ID NO: 1398357 - protein, 9 aa, Homo Sapiens
KHIILFLFL

SEQ ID NO: 1398358 - protein, 9 aa, Homo Sapiens
TWASLATLA

SEQ ID NO: 1398359 - protein, 9 aa, Homo Sapiens
GCGGIIMAL

SEQ ID NO: 1398360 - protein, 9 aa, Homo Sapiens
TYSSVCVLP

SEQ ID NO: 1398361 - protein, 9 aa, Homo Sapiens
RRGSPGSLP

SEQ ID NO: 1398362 - protein, 9 aa, Homo Sapiens
IFMGVIEFY

SEQ ID NO: 1398363 - protein, 9 aa, Homo Sapiens
EQLPQHALV

SEQ ID NO: 1398364 - protein, 9 aa, Homo Sapiens
AQFVSQINH

SEQ ID NO: 1398365 - protein, 9 aa, Homo Sapiens
EVIEDFLRN

SEQ ID NO: 1398366 - protein, 9 aa, Homo Sapiens
QELEKSNGT

SEQ ID NO: 1398367 - protein, 9 aa, Homo Sapiens
GMPSMPSSC

SEQ ID NO: 1398368 - protein, 9 aa, Homo Sapiens
YPRESSWLS

SEQ ID NO: 1398369 - protein, 9 aa, Homo Sapiens
LDILPLQAV

SEQ ID NO: 1398370 - protein, 9 aa, Homo Sapiens
VFFGYTFVA

SEQ ID NO: 1398371 - protein, 9 aa, Homo Sapiens
PEGFQDKRV

SEQ ID NO: 1398372 - protein, 9 aa, Homo Sapiens
PPRTREETR

SEQ ID NO: 1398373 - protein, 9 aa, Homo Sapiens
QVQLSEDEE

SEQ ID NO: 1398374 - protein, 9 aa, Homo Sapiens
LCGYPGPAA

SEQ ID NO: 1398375 - protein, 9 aa, Homo Sapiens
GVCGHLKPS

SEQ ID NO: 1398376 - protein, 9 aa, Homo Sapiens
PDEADSPRH

SEQ ID NO: 1398377 - protein, 9 aa, Homo Sapiens
PWPASTCPL

SEQ ID NO: 1398378 - protein, 9 aa, Homo Sapiens
WLISLADYP

SEQ ID NO: 1398379 - protein, 9 aa, Homo Sapiens
RRRRERRSD

SEQ ID NO: 1398380 - protein, 9 aa, Homo Sapiens
GTARPSESS

SEQ ID NO: 1398381 - protein, 9 aa, Homo Sapiens
CCRLWCFPQ

SEQ ID NO: 1398382 - protein, 9 aa, Homo Sapiens
EDFLRNFLI

SEQ ID NO: 1398383 - protein, 9 aa, Homo Sapiens
RWPSLESSG

SEQ ID NO: 1398384 - protein, 9 aa, Homo Sapiens
KWMDRYKID

SEQ ID NO: 1398385 - protein, 9 aa, Homo Sapiens
NTVHDVVNR

SEQ ID NO: 1398386 - protein, 9 aa, Homo Sapiens
STSTSVSRH

SEQ ID NO: 1398387 - protein, 9 aa, Homo Sapiens
GREYVQAGW

SEQ ID NO: 1398388 - protein, 9 aa, Homo Sapiens
WKSIFRLYS

SEQ ID NO: 1398389 - protein, 9 aa, Homo Sapiens
AASPRAAIW

SEQ ID NO: 1398390 - protein, 9 aa, Homo Sapiens
TLQLLRTFM

SEQ ID NO: 1398391 - protein, 9 aa, Homo Sapiens
TSNWKKPWK

SEQ ID NO: 1398392 - protein, 9 aa, Homo Sapiens
HQLATSSQD

SEQ ID NO: 1398393 - protein, 9 aa, Homo Sapiens
TDLQLSTPQ

SEQ ID NO: 1398394 - protein, 9 aa, Homo Sapiens
RDTKLPASR

SEQ ID NO: 1398395 - protein, 9 aa, Homo Sapiens
GSAACHRRG

SEQ ID NO: 1398396 - protein, 9 aa, Homo Sapiens
ADINLIDVY

SEQ ID NO: 1398397 - protein, 9 aa, Homo Sapiens
ALDLSPLYR

SEQ ID NO: 1398398 - protein, 9 aa, Homo Sapiens
QATGPPPAV

SEQ ID NO: 1398399 - protein, 9 aa, Homo Sapiens
ALLLLPPLL

SEQ ID NO: 1398400 - protein, 9 aa, Homo Sapiens
HGASCTTQR

SEQ ID NO: 1398401 - protein, 9 aa, Homo Sapiens
REVLMQKCI

SEQ ID NO: 1398402 - protein, 9 aa, Homo Sapiens
WEETPVAES

SEQ ID NO: 1398403 - protein, 9 aa, Homo Sapiens
DVVLMQFCA

SEQ ID NO: 1398404 - protein, 9 aa, Homo Sapiens
YLVTFWEEG

SEQ ID NO: 1398405 - protein, 9 aa, Homo Sapiens
PSDRQDWQN

SEQ ID NO: 1398406 - protein, 9 aa, Homo Sapiens
DKKNGIWEV

SEQ ID NO: 1398407 - protein, 9 aa, Homo Sapiens
APPPYSESD

SEQ ID NO: 1398408 - protein, 9 aa, Homo Sapiens
SEKLDPQPF

SEQ ID NO: 1398409 - protein, 9 aa, Homo Sapiens
SSHQAYGAS

SEQ ID NO: 1398410 - protein, 9 aa, Homo Sapiens
GGHPEPLDG

SEQ ID NO: 1398411 - protein, 9 aa, Homo Sapiens
VPRIHRWTI

SEQ ID NO: 1398412 - protein, 9 aa, Homo Sapiens
RTTMKRPFL

SEQ ID NO: 1398413 - protein, 9 aa, Homo Sapiens
PPPAATSAQ

SEQ ID NO: 1398414 - protein, 9 aa, Homo Sapiens
QLHHSMTRF

SEQ ID NO: 1398415 - protein, 9 aa, Homo Sapiens
SMSFGATSP

SEQ ID NO: 1398416 - protein, 9 aa, Homo Sapiens
LFILCLCTC

SEQ ID NO: 1398417 - protein, 9 aa, Homo Sapiens
GYIPSSLAQ

SEQ ID NO: 1398418 - protein, 9 aa, Homo Sapiens
LYTLGAVQI

SEQ ID NO: 1398419 - protein, 9 aa, Homo Sapiens
FNNLKNCIY

SEQ ID NO: 1398420 - protein, 9 aa, Homo Sapiens
EEESWEKSF

SEQ ID NO: 1398421 - protein, 9 aa, Homo Sapiens
TTEGVSPPF

SEQ ID NO: 1398422 - protein, 9 aa, Homo Sapiens
PLLITSSLS

SEQ ID NO: 1398423 - protein, 9 aa, Homo Sapiens
PLPSSTGKT

SEQ ID NO: 1398424 - protein, 9 aa, Homo Sapiens
STGMGRPPA

SEQ ID NO: 1398425 - protein, 9 aa, Homo Sapiens
LLPPELPPA

SEQ ID NO: 1398426 - protein, 9 aa, Homo Sapiens
DWKMTNVQI

SEQ ID NO: 1398427 - protein, 9 aa, Homo Sapiens
DAPPPPTPA

SEQ ID NO: 1398428 - protein, 9 aa, Homo Sapiens
SRHVGGKAP

SEQ ID NO: 1398429 - protein, 9 aa, Homo Sapiens
LIIQTTGYQ

SEQ ID NO: 1398430 - protein, 9 aa, Homo Sapiens
VKRLCQGRM

SEQ ID NO: 1398431 - protein, 9 aa, Homo Sapiens
IQVQTGGRL

SEQ ID NO: 1398432 - protein, 9 aa, Homo Sapiens
QHFYWHCGS

SEQ ID NO: 1398433 - protein, 9 aa, Homo Sapiens
RSAEQSPVV

SEQ ID NO: 1398434 - protein, 9 aa, Homo Sapiens
RDLTQLAVI

SEQ ID NO: 1398435 - protein, 9 aa, Homo Sapiens
PRLHVRRGG

SEQ ID NO: 1398436 - protein, 9 aa, Homo Sapiens
MAAAPHTRL

SEQ ID NO: 1398437 - protein, 9 aa, Homo Sapiens
QSVCSQGSL

SEQ ID NO: 1398438 - protein, 9 aa, Homo Sapiens
GEISTTRVP

SEQ ID NO: 1398439 - protein, 9 aa, Homo Sapiens
STDPTHTKI

SEQ ID NO: 1398440 - protein, 9 aa, Homo Sapiens
EERVLKNPP

SEQ ID NO: 1398441 - protein, 9 aa, Homo Sapiens
VTGQMWVMS

SEQ ID NO: 1398442 - protein, 9 aa, Homo Sapiens
EWNDGRDPF

SEQ ID NO: 1398443 - protein, 9 aa, Homo Sapiens
KMYEHLWTS

SEQ ID NO: 1398444 - protein, 9 aa, Homo Sapiens
GTASPTTPS

SEQ ID NO: 1398445 - protein, 9 aa, Homo Sapiens
KPFRCEIYG

SEQ ID NO: 1398446 - protein, 9 aa, Homo Sapiens
LAHNAKDVS

SEQ ID NO: 1398447 - protein, 9 aa, Homo Sapiens
EQLFSQYER

SEQ ID NO: 1398448 - protein, 9 aa, Homo Sapiens
VIKKRDQCF

SEQ ID NO: 1398449 - protein, 9 aa, Homo Sapiens
RFVLPVGAM

SEQ ID NO: 1398450 - protein, 9 aa, Homo Sapiens
LCLALGSRG

SEQ ID NO: 1398451 - protein, 9 aa, Homo Sapiens
CGVTGLKLQ

SEQ ID NO: 1398452 - protein, 9 aa, Homo Sapiens
DQKREKKNQ

SEQ ID NO: 1398453 - protein, 9 aa, Homo Sapiens
YRETYCACR

SEQ ID NO: 1398454 - protein, 9 aa, Homo Sapiens
YSSGLFLLV

SEQ ID NO: 1398455 - protein, 9 aa, Homo Sapiens
PVCKPGWQR

SEQ ID NO: 1398456 - protein, 9 aa, Homo Sapiens
DGPWGRSRA

SEQ ID NO: 1398457 - protein, 9 aa, Homo Sapiens
ALPTANGLH

SEQ ID NO: 1398458 - protein, 9 aa, Homo Sapiens
RMGPVSPAT

SEQ ID NO: 1398459 - protein, 9 aa, Homo Sapiens
DYASTSTSV

SEQ ID NO: 1398460 - protein, 9 aa, Homo Sapiens
LQLCQKEQS

SEQ ID NO: 1398461 - protein, 9 aa, Homo Sapiens
KKDEAFYHH

SEQ ID NO: 1398462 - protein, 9 aa, Homo Sapiens
YPQRPKPSS

SEQ ID NO: 1398463 - protein, 9 aa, Homo Sapiens
LPSSTGKTG

SEQ ID NO: 1398464 - protein, 9 aa, Homo Sapiens
SVRPVEDLS

SEQ ID NO: 1398465 - protein, 9 aa, Homo Sapiens
PPTKKKGAK

SEQ ID NO: 1398466 - protein, 9 aa, Homo Sapiens
HKSTSSSPT

SEQ ID NO: 1398467 - protein, 9 aa, Homo Sapiens
CKPGWQRLD

SEQ ID NO: 1398468 - protein, 9 aa, Homo Sapiens
QNSVLQAAW

SEQ ID NO: 1398469 - protein, 9 aa, Homo Sapiens
EGTNGTEEQ

SEQ ID NO: 1398470 - protein, 9 aa, Homo Sapiens
ALMPAATIA

SEQ ID NO: 1398471 - protein, 9 aa, Homo Sapiens
EDTDPRHLV

SEQ ID NO: 1398472 - protein, 9 aa, Homo Sapiens
VPWRLSSLP

SEQ ID NO: 1398473 - protein, 9 aa, Homo Sapiens
TTWLLSGRV

SEQ ID NO: 1398474 - protein, 9 aa, Homo Sapiens
AGRGAPRHP

SEQ ID NO: 1398475 - protein, 9 aa, Homo Sapiens
SVSCSNIFL

SEQ ID NO: 1398476 - protein, 9 aa, Homo Sapiens
LKNIPGIRG

SEQ ID NO: 1398477 - protein, 9 aa, Homo Sapiens
ESLNRYIEK

SEQ ID NO: 1398478 - protein, 9 aa, Homo Sapiens
LPPNTKDRL

SEQ ID NO: 1398479 - protein, 9 aa, Homo Sapiens
GEKGDPGQP

SEQ ID NO: 1398480 - protein, 9 aa, Homo Sapiens
SSTMLPVQY

SEQ ID NO: 1398481 - protein, 9 aa, Homo Sapiens
RTMLCFWTP

SEQ ID NO: 1398482 - protein, 9 aa, Homo Sapiens
CDIDRYRGP

SEQ ID NO: 1398483 - protein, 9 aa, Homo Sapiens
RRPRKKPPR

SEQ ID NO: 1398484 - protein, 9 aa, Homo Sapiens
LDGMLTVIG

SEQ ID NO: 1398485 - protein, 9 aa, Homo Sapiens
SCLKFLSPQ

SEQ ID NO: 1398486 - protein, 9 aa, Homo Sapiens
TMGTARPSE

SEQ ID NO: 1398487 - protein, 9 aa, Homo Sapiens
GWQRLDQED

SEQ ID NO: 1398488 - protein, 9 aa, Homo Sapiens
SPTTPSQHF

SEQ ID NO: 1398489 - protein, 9 aa, Homo Sapiens
CTPASGPSP

SEQ ID NO: 1398490 - protein, 9 aa, Homo Sapiens
SVCSSLTTH

SEQ ID NO: 1398491 - protein, 9 aa, Homo Sapiens
RAMHPYYLP

SEQ ID NO: 1398492 - protein, 9 aa, Homo Sapiens
FIAMDVMCY

SEQ ID NO: 1398493 - protein, 9 aa, Homo Sapiens
KVLCFELER

SEQ ID NO: 1398494 - protein, 9 aa, Homo Sapiens
LAGSRTPIP

SEQ ID NO: 1398495 - protein, 9 aa, Homo Sapiens
LTFPGWFFG

SEQ ID NO: 1398496 - protein, 9 aa, Homo Sapiens
QAIAVQAGD

SEQ ID NO: 1398497 - protein, 9 aa, Homo Sapiens
SSSPKARVS

SEQ ID NO: 1398498 - protein, 9 aa, Homo Sapiens
GEKISSWQV

SEQ ID NO: 1398499 - protein, 9 aa, Homo Sapiens
AWCCSWHLP

SEQ ID NO: 1398500 - protein, 9 aa, Homo Sapiens
SQETTRMED

SEQ ID NO: 1398501 - protein, 9 aa, Homo Sapiens
EGPPRTREE

SEQ ID NO: 1398502 - protein, 9 aa, Homo Sapiens
SLLASHHSV

SEQ ID NO: 1398503 - protein, 9 aa, Homo Sapiens
YSEGAFNDN

SEQ ID NO: 1398504 - protein, 9 aa, Homo Sapiens
VQTMNRICV

SEQ ID NO: 1398505 - protein, 9 aa, Homo Sapiens
LPWTLRKQP

SEQ ID NO: 1398506 - protein, 9 aa, Homo Sapiens
MKRPFLWDP

SEQ ID NO: 1398507 - protein, 9 aa, Homo Sapiens
EADSLSDKS

SEQ ID NO: 1398508 - protein, 9 aa, Homo Sapiens
PEERGRTQP

SEQ ID NO: 1398509 - protein, 9 aa, Homo Sapiens
YSESDSQAS

SEQ ID NO: 1398510 - protein, 9 aa, Homo Sapiens
LLHQPLPGQ

SEQ ID NO: 1398511 - protein, 9 aa, Homo Sapiens
HQITLLECV

SEQ ID NO: 1398512 - protein, 9 aa, Homo Sapiens
VVLMQFCAN

SEQ ID NO: 1398513 - protein, 9 aa, Homo Sapiens
SHSHWVLSP

SEQ ID NO: 1398514 - protein, 9 aa, Homo Sapiens
PSRDSLGAK

SEQ ID NO: 1398515 - protein, 9 aa, Homo Sapiens
HEVVKMHVK

SEQ ID NO: 1398516 - protein, 9 aa, Homo Sapiens
TLARSLVPQ

SEQ ID NO: 1398517 - protein, 9 aa, Homo Sapiens
RACRAGGPA

SEQ ID NO: 1398518 - protein, 9 aa, Homo Sapiens
VIEFYILTA

SEQ ID NO: 1398519 - protein, 9 aa, Homo Sapiens
LILICDQLF

SEQ ID NO: 1398520 - protein, 9 aa, Homo Sapiens
NIGVKTVMI

SEQ ID NO: 1398521 - protein, 9 aa, Homo Sapiens
LEKLEKKDY

SEQ ID NO: 1398522 - protein, 9 aa, Homo Sapiens
LVGLQILHP

SEQ ID NO: 1398523 - protein, 9 aa, Homo Sapiens
VCHLCLEPP

SEQ ID NO: 1398524 - protein, 9 aa, Homo Sapiens
HRLRLRLPR

SEQ ID NO: 1398525 - protein, 9 aa, Homo Sapiens
GFQDKRVLV

SEQ ID NO: 1398526 - protein, 9 aa, Homo Sapiens
QVHKVCVKE

SEQ ID NO: 1398527 - protein, 9 aa, Homo Sapiens
CGGLYNICS

SEQ ID NO: 1398528 - protein, 9 aa, Homo Sapiens
ESGHKKVTA

SEQ ID NO: 1398529 - protein, 9 aa, Homo Sapiens
HGVGRIWLD

SEQ ID NO: 1398530 - protein, 9 aa, Homo Sapiens
CSNIFLNFN

SEQ ID NO: 1398531 - protein, 9 aa, Homo Sapiens
APACLLGPV

SEQ ID NO: 1398532 - protein, 9 aa, Homo Sapiens
AAAPHTRLW

SEQ ID NO: 1398533 - protein, 9 aa, Homo Sapiens
IWFQNHRVK

SEQ ID NO: 1398534 - protein, 9 aa, Homo Sapiens
FNKKRKKMF

SEQ ID NO: 1398535 - protein, 9 aa, Homo Sapiens
DTKLPKAEE

SEQ ID NO: 1398536 - protein, 9 aa, Homo Sapiens
AALPTANGL

SEQ ID NO: 1398537 - protein, 9 aa, Homo Sapiens
RPKKCPLLL

SEQ ID NO: 1398538 - protein, 9 aa, Homo Sapiens
KIWFQNHRV

SEQ ID NO: 1398539 - protein, 9 aa, Homo Sapiens
RDFRPLEKC

SEQ ID NO: 1398540 - protein, 9 aa, Homo Sapiens
QAGDGHGRL

SEQ ID NO: 1398541 - protein, 9 aa, Homo Sapiens
GRGSNSWVN

SEQ ID NO: 1398542 - protein, 9 aa, Homo Sapiens
EEILVRIGS

SEQ ID NO: 1398543 - protein, 9 aa, Homo Sapiens
WGVPRKMIL

SEQ ID NO: 1398544 - protein, 9 aa, Homo Sapiens
LDHFLTCSF

SEQ ID NO: 1398545 - protein, 9 aa, Homo Sapiens
GQHLWLSHR

SEQ ID NO: 1398546 - protein, 9 aa, Homo Sapiens
LPNKPPLRT

SEQ ID NO: 1398547 - protein, 9 aa, Homo Sapiens
WQLDANPSS

SEQ ID NO: 1398548 - protein, 9 aa, Homo Sapiens
TRMEDATER

SEQ ID NO: 1398549 - protein, 9 aa, Homo Sapiens
ARGRTGAVT

SEQ ID NO: 1398550 - protein, 9 aa, Homo Sapiens
WVMSRACPS

SEQ ID NO: 1398551 - protein, 9 aa, Homo Sapiens
QPGPPGPVG

SEQ ID NO: 1398552 - protein, 9 aa, Homo Sapiens
RHSSVLATG

SEQ ID NO: 1398553 - protein, 9 aa, Homo Sapiens
SSPSSCNPP

SEQ ID NO: 1398554 - protein, 9 aa, Homo Sapiens
ILSFMGIFE

SEQ ID NO: 1398555 - protein, 9 aa, Homo Sapiens
VEHTVSEFI

SEQ ID NO: 1398556 - protein, 9 aa, Homo Sapiens
PDQREGDRG

SEQ ID NO: 1398557 - protein, 9 aa, Homo Sapiens
QVPTSLPMT

SEQ ID NO: 1398558 - protein, 9 aa, Homo Sapiens
SQYERIITS

SEQ ID NO: 1398559 - protein, 9 aa, Homo Sapiens
LCVDAGFLS

SEQ ID NO: 1398560 - protein, 9 aa, Homo Sapiens
SPLLSGARG

SEQ ID NO: 1398561 - protein, 9 aa, Homo Sapiens
AANHDVGSE

SEQ ID NO: 1398562 - protein, 9 aa, Homo Sapiens
ELNCCRDVV

SEQ ID NO: 1398563 - protein, 9 aa, Homo Sapiens
TRVPDEADS

SEQ ID NO: 1398564 - protein, 9 aa, Homo Sapiens
QDYASTSTS

SEQ ID NO: 1398565 - protein, 9 aa, Homo Sapiens
KSTSSSPTG

SEQ ID NO: 1398566 - protein, 9 aa, Homo Sapiens
QFIPSQPPT

SEQ ID NO: 1398567 - protein, 9 aa, Homo Sapiens
RCEIYGKCF

SEQ ID NO: 1398568 - protein, 9 aa, Homo Sapiens
PITGILVDT

SEQ ID NO: 1398569 - protein, 9 aa, Homo Sapiens
LCGADSNPR

SEQ ID NO: 1398570 - protein, 9 aa, Homo Sapiens
KPNFFVTLL

SEQ ID NO: 1398571 - protein, 9 aa, Homo Sapiens
SHHLVSMKS

SEQ ID NO: 1398572 - protein, 9 aa, Homo Sapiens
LKYVTYRNI

SEQ ID NO: 1398573 - protein, 9 aa, Homo Sapiens
FTQESSILS

SEQ ID NO: 1398574 - protein, 9 aa, Homo Sapiens
MGVVQNEPA

SEQ ID NO: 1398575 - protein, 9 aa, Homo Sapiens
KPHSPPRAL

SEQ ID NO: 1398576 - protein, 9 aa, Homo Sapiens
IVLQHEYGP

SEQ ID NO: 1398577 - protein, 9 aa, Homo Sapiens
KRGPSQLPH

SEQ ID NO: 1398578 - protein, 9 aa, Homo Sapiens
KYGMVAPHT

SEQ ID NO: 1398579 - protein, 9 aa, Homo Sapiens
SALLCYDRV

SEQ ID NO: 1398580 - protein, 9 aa, Homo Sapiens
RLEAMEPPG

SEQ ID NO: 1398581 - protein, 9 aa, Homo Sapiens
QMIRTLNAD

SEQ ID NO: 1398582 - protein, 9 aa, Homo Sapiens
WLTHLLYYT

SEQ ID NO: 1398583 - protein, 9 aa, Homo Sapiens
QGHQGPWHH

SEQ ID NO: 1398584 - protein, 9 aa, Homo Sapiens
FVDIPAKKG

SEQ ID NO: 1398585 - protein, 9 aa, Homo Sapiens
QLMHLRGDI

SEQ ID NO: 1398586 - protein, 9 aa, Homo Sapiens
YIEKSNSVK

SEQ ID NO: 1398587 - protein, 9 aa, Homo Sapiens
HQAYGASLY

SEQ ID NO: 1398588 - protein, 9 aa, Homo Sapiens
RLCQGRMFC

SEQ ID NO: 1398589 - protein, 9 aa, Homo Sapiens
KENAALPTA

SEQ ID NO: 1398590 - protein, 9 aa, Homo Sapiens
VIKAGQAGH

SEQ ID NO: 1398591 - protein, 9 aa, Homo Sapiens
SPDPSMTTS

SEQ ID NO: 1398592 - protein, 9 aa, Homo Sapiens
WPALLGSGG

SEQ ID NO: 1398593 - protein, 9 aa, Homo Sapiens
HPVDDARPP

SEQ ID NO: 1398594 - protein, 9 aa, Homo Sapiens
LCVRPREQK

SEQ ID NO: 1398595 - protein, 9 aa, Homo Sapiens
RPPAAVRER

SEQ ID NO: 1398596 - protein, 9 aa, Homo Sapiens
LPKCRVPAP

SEQ ID NO: 1398597 - protein, 9 aa, Homo Sapiens
ETLEDLKIY

SEQ ID NO: 1398598 - protein, 9 aa, Homo Sapiens
NSLSSAEGG

SEQ ID NO: 1398599 - protein, 9 aa, Homo Sapiens
RGSPGSLPK

SEQ ID NO: 1398600 - protein, 9 aa, Homo Sapiens
LATAWEPTW

SEQ ID NO: 1398601 - protein, 9 aa, Homo Sapiens
LLPQQRFCG

SEQ ID NO: 1398602 - protein, 9 aa, Homo Sapiens
LIGCGGIIM

SEQ ID NO: 1398603 - protein, 9 aa, Homo Sapiens
WMGARGPTP

SEQ ID NO: 1398604 - protein, 9 aa, Homo Sapiens
QNKKVVEEE

SEQ ID NO: 1398605 - protein, 9 aa, Homo Sapiens
AWQSITMGT

SEQ ID NO: 1398606 - protein, 9 aa, Homo Sapiens
GPPPRARPG

SEQ ID NO: 1398607 - protein, 9 aa, Homo Sapiens
VGLAASFAV

SEQ ID NO: 1398608 - protein, 9 aa, Homo Sapiens
ISSSLSLLA

SEQ ID NO: 1398609 - protein, 9 aa, Homo Sapiens
FNYKSIIIV

SEQ ID NO: 1398610 - protein, 9 aa, Homo Sapiens
EVDKYGMVA

SEQ ID NO: 1398611 - protein, 9 aa, Homo Sapiens
PAASMRPDG

SEQ ID NO: 1398612 - protein, 9 aa, Homo Sapiens
CAHYPRESS

SEQ ID NO: 1398613 - protein, 9 aa, Homo Sapiens
NDAGALSQD

SEQ ID NO: 1398614 - protein, 9 aa, Homo Sapiens
LVGMTPRDL

SEQ ID NO: 1398615 - protein, 9 aa, Homo Sapiens
CIHLVQIVE

SEQ ID NO: 1398616 - protein, 9 aa, Homo Sapiens
DHSISILGV

SEQ ID NO: 1398617 - protein, 9 aa, Homo Sapiens
RLLLGVCGH

SEQ ID NO: 1398618 - protein, 9 aa, Homo Sapiens
YIFTRPTYS

SEQ ID NO: 1398619 - protein, 9 aa, Homo Sapiens
MIQVLMSVV

SEQ ID NO: 1398620 - protein, 9 aa, Homo Sapiens
GQMWVMSRA

SEQ ID NO: 1398621 - protein, 9 aa, Homo Sapiens
QEGAASQDT

SEQ ID NO: 1398622 - protein, 9 aa, Homo Sapiens
LRTLTEYAR

SEQ ID NO: 1398623 - protein, 9 aa, Homo Sapiens
PRTPPKITS

SEQ ID NO: 1398624 - protein, 9 aa, Homo Sapiens
FFSQTYMHP

SEQ ID NO: 1398625 - protein, 9 aa, Homo Sapiens
SYIIMVLFA

SEQ ID NO: 1398626 - protein, 9 aa, Homo Sapiens
WSRSPRMRH

SEQ ID NO: 1398627 - protein, 9 aa, Homo Sapiens
SPAVAVPTP

SEQ ID NO: 1398628 - protein, 9 aa, Homo Sapiens
YVCENCKPL

SEQ ID NO: 1398629 - protein, 9 aa, Homo Sapiens
SEAASLVED

SEQ ID NO: 1398630 - protein, 9 aa, Homo Sapiens
TYMHPMKTA

SEQ ID NO: 1398631 - protein, 9 aa, Homo Sapiens
KPPLRTTMK

SEQ ID NO: 1398632 - protein, 9 aa, Homo Sapiens
LQALFQVAT

SEQ ID NO: 1398633 - protein, 9 aa, Homo Sapiens
EVRRLPKPA

SEQ ID NO: 1398634 - protein, 9 aa, Homo Sapiens
LQDGSLDRN

SEQ ID NO: 1398635 - protein, 9 aa, Homo Sapiens
VMSLGEDLA

SEQ ID NO: 1398636 - protein, 9 aa, Homo Sapiens
MAHAFPPGP

SEQ ID NO: 1398637 - protein, 9 aa, Homo Sapiens
ACIHMMPNA

SEQ ID NO: 1398638 - protein, 9 aa, Homo Sapiens
PELPPASPL

SEQ ID NO: 1398639 - protein, 9 aa, Homo Sapiens
VYIASTRLF

SEQ ID NO: 1398640 - protein, 9 aa, Homo Sapiens
GYRSCAVNK

SEQ ID NO: 1398641 - protein, 9 aa, Homo Sapiens
SQAVIADGK

SEQ ID NO: 1398642 - protein, 9 aa, Homo Sapiens
LPVGFIHQA

SEQ ID NO: 1398643 - protein, 9 aa, Homo Sapiens
RDMLYFYAE

SEQ ID NO: 1398644 - protein, 9 aa, Homo Sapiens
QRSRRHRDR

SEQ ID NO: 1398645 - protein, 9 aa, Homo Sapiens
VGGSLGQGL

SEQ ID NO: 1398646 - protein, 9 aa, Homo Sapiens
QTTGYQSIK

SEQ ID NO: 1398647 - protein, 9 aa, Homo Sapiens
TSHIMQYGN

SEQ ID NO: 1398648 - protein, 9 aa, Homo Sapiens
LLCPGHVSV

SEQ ID NO: 1398649 - protein, 9 aa, Homo Sapiens
RDKKKGQHF

SEQ ID NO: 1398650 - protein, 9 aa, Homo Sapiens
EILSFMGIF

SEQ ID NO: 1398651 - protein, 9 aa, Homo Sapiens
SGGAWKSIF

SEQ ID NO: 1398652 - protein, 9 aa, Homo Sapiens
YPAVPRYHV

SEQ ID NO: 1398653 - protein, 9 aa, Homo Sapiens
CMKVLVLVL

SEQ ID NO: 1398654 - protein, 9 aa, Homo Sapiens
YRWPGDSDV

SEQ ID NO: 1398655 - protein, 9 aa, Homo Sapiens
GSDMFVNTE

SEQ ID NO: 1398656 - protein, 9 aa, Homo Sapiens
CSAACRWPS

SEQ ID NO: 1398657 - protein, 9 aa, Homo Sapiens
EIREVHEWN

SEQ ID NO: 1398658 - protein, 9 aa, Homo Sapiens
LEGDLQHAL

SEQ ID NO: 1398659 - protein, 9 aa, Homo Sapiens
PWQGLKAAI

SEQ ID NO: 1398660 - protein, 9 aa, Homo Sapiens
RAHPMLKAI

SEQ ID NO: 1398661 - protein, 9 aa, Homo Sapiens
PPSAPASKD

SEQ ID NO: 1398662 - protein, 9 aa, Homo Sapiens
FLWDPASRL

SEQ ID NO: 1398663 - protein, 9 aa, Homo Sapiens
ILSTYQMTP

SEQ ID NO: 1398664 - protein, 9 aa, Homo Sapiens
LVTFWEEGR

SEQ ID NO: 1398665 - protein, 9 aa, Homo Sapiens
DTQLTRLMR

SEQ ID NO: 1398666 - protein, 9 aa, Homo Sapiens
RLSTSAPTM

SEQ ID NO: 1398667 - protein, 9 aa, Homo Sapiens
DSQLEFKRI

SEQ ID NO: 1398668 - protein, 9 aa, Homo Sapiens
LAQESGHKK

SEQ ID NO: 1398669 - protein, 9 aa, Homo Sapiens
YSEFRKIFE

SEQ ID NO: 1398670 - protein, 9 aa, Homo Sapiens
RAQSAEEPW

SEQ ID NO: 1398671 - protein, 9 aa, Homo Sapiens
LMVIVIVLY

SEQ ID NO: 1398672 - protein, 9 aa, Homo Sapiens
SVALDILPL

SEQ ID NO: 1398673 - protein, 9 aa, Homo Sapiens
GWTPRPHGL

SEQ ID NO: 1398674 - protein, 9 aa, Homo Sapiens
HLSPLSTLK

SEQ ID NO: 1398675 - protein, 9 aa, Homo Sapiens
EDGVRAPFT

SEQ ID NO: 1398676 - protein, 9 aa, Homo Sapiens
RTLYRDMML

SEQ ID NO: 1398677 - protein, 9 aa, Homo Sapiens
TCDYVGGYF

SEQ ID NO: 1398678 - protein, 9 aa, Homo Sapiens
EEGHQELDE

SEQ ID NO: 1398679 - protein, 9 aa, Homo Sapiens
SSQTRYAQS

SEQ ID NO: 1398680 - protein, 9 aa, Homo Sapiens
HAMRERIRV

SEQ ID NO: 1398681 - protein, 9 aa, Homo Sapiens
GETYSSVCV

SEQ ID NO: 1398682 - protein, 9 aa, Homo Sapiens
GLHTSPPPG

SEQ ID NO: 1398683 - protein, 9 aa, Homo Sapiens
AYGESQRWK

SEQ ID NO: 1398684 - protein, 9 aa, Homo Sapiens
SDILEETWE

SEQ ID NO: 1398685 - protein, 9 aa, Homo Sapiens
TYHGGGAPL

SEQ ID NO: 1398686 - protein, 9 aa, Homo Sapiens
PLRPLSGPP

SEQ ID NO: 1398687 - protein, 9 aa, Homo Sapiens
KGECNHPWS

SEQ ID NO: 1398688 - protein, 9 aa, Homo Sapiens
GTVAGATAQ

SEQ ID NO: 1398689 - protein, 9 aa, Homo Sapiens
HYPRESSWL

SEQ ID NO: 1398690 - protein, 9 aa, Homo Sapiens
VELLRAALK

SEQ ID NO: 1398691 - protein, 9 aa, Homo Sapiens
WDPASRLST

SEQ ID NO: 1398692 - protein, 9 aa, Homo Sapiens
SQYPWKEYK

SEQ ID NO: 1398693 - protein, 9 aa, Homo Sapiens
DVLHSELNY

SEQ ID NO: 1398694 - protein, 9 aa, Homo Sapiens
EEPSKALHG

SEQ ID NO: 1398695 - protein, 9 aa, Homo Sapiens
DACVGMIAE

SEQ ID NO: 1398696 - protein, 9 aa, Homo Sapiens
KYEERVLKN

SEQ ID NO: 1398697 - protein, 9 aa, Homo Sapiens
PKARVSFWS

SEQ ID NO: 1398698 - protein, 9 aa, Homo Sapiens
VPHLLLMKR

SEQ ID NO: 1398699 - protein, 9 aa, Homo Sapiens
DVKEEANKA

SEQ ID NO: 1398700 - protein, 9 aa, Homo Sapiens
CNTVHDVVN

SEQ ID NO: 1398701 - protein, 9 aa, Homo Sapiens
SLLEQQILS

SEQ ID NO: 1398702 - protein, 9 aa, Homo Sapiens
HRMRARLQS

SEQ ID NO: 1398703 - protein, 9 aa, Homo Sapiens
WAWTCPRKA

SEQ ID NO: 1398704 - protein, 9 aa, Homo Sapiens
ARSPTSSPT

SEQ ID NO: 1398705 - protein, 9 aa, Homo Sapiens
SHWSRSRGL

SEQ ID NO: 1398706 - protein, 9 aa, Homo Sapiens
CIIAAVKIF

SEQ ID NO: 1398707 - protein, 9 aa, Homo Sapiens
KTSGQPSDV

SEQ ID NO: 1398708 - protein, 9 aa, Homo Sapiens
TVHLQTLLE

SEQ ID NO: 1398709 - protein, 9 aa, Homo Sapiens
PITSSTDPT

SEQ ID NO: 1398710 - protein, 9 aa, Homo Sapiens
PDRDPMLSP

SEQ ID NO: 1398711 - protein, 9 aa, Homo Sapiens
FDAGTLLST

SEQ ID NO: 1398712 - protein, 9 aa, Homo Sapiens
RSHGASCTT

SEQ ID NO: 1398713 - protein, 9 aa, Homo Sapiens
FCIVLCMAV

SEQ ID NO: 1398714 - protein, 9 aa, Homo Sapiens
RYRSLVHTA

SEQ ID NO: 1398715 - protein, 9 aa, Homo Sapiens
GGSPISPVI

SEQ ID NO: 1398716 - protein, 9 aa, Homo Sapiens
TQVVNAKKK

SEQ ID NO: 1398717 - protein, 9 aa, Homo Sapiens
KAFLPERKC

SEQ ID NO: 1398718 - protein, 9 aa, Homo Sapiens
EELLVPKRI

SEQ ID NO: 1398719 - protein, 9 aa, Homo Sapiens
QRWKIPIGW

SEQ ID NO: 1398720 - protein, 9 aa, Homo Sapiens
QMSSWATCG

SEQ ID NO: 1398721 - protein, 9 aa, Homo Sapiens
KKAFCEPLW

SEQ ID NO: 1398722 - protein, 9 aa, Homo Sapiens
DVDGPGGPG

SEQ ID NO: 1398723 - protein, 9 aa, Homo Sapiens
SDVGSRPLL

SEQ ID NO: 1398724 - protein, 9 aa, Homo Sapiens
REYVQAGWP

SEQ ID NO: 1398725 - protein, 9 aa, Homo Sapiens
VALSLDRCL

SEQ ID NO: 1398726 - protein, 9 aa, Homo Sapiens
PANRYRSLV

SEQ ID NO: 1398727 - protein, 9 aa, Homo Sapiens
MFCSGNAVV

SEQ ID NO: 1398728 - protein, 9 aa, Homo Sapiens
KKRDQCFQM

SEQ ID NO: 1398729 - protein, 9 aa, Homo Sapiens
INSVQQHRE

SEQ ID NO: 1398730 - protein, 9 aa, Homo Sapiens
LNMIQVLMS

SEQ ID NO: 1398731 - protein, 9 aa, Homo Sapiens
SAVPSVARP

SEQ ID NO: 1398732 - protein, 9 aa, Homo Sapiens
LFHVGSSFT

SEQ ID NO: 1398733 - protein, 9 aa, Homo Sapiens
FLELRQGLT

SEQ ID NO: 1398734 - protein, 9 aa, Homo Sapiens
RRTWWRTRA

SEQ ID NO: 1398735 - protein, 9 aa, Homo Sapiens
PSESSQSTA

SEQ ID NO: 1398736 - protein, 9 aa, Homo Sapiens
SGLWFTSRV

SEQ ID NO: 1398737 - protein, 9 aa, Homo Sapiens
PLHYNVLMS

SEQ ID NO: 1398738 - protein, 9 aa, Homo Sapiens
ASTASDHGC

SEQ ID NO: 1398739 - protein, 9 aa, Homo Sapiens
PHGSPGPRM

SEQ ID NO: 1398740 - protein, 9 aa, Homo Sapiens
EHIHAKGSY

SEQ ID NO: 1398741 - protein, 9 aa, Homo Sapiens
LPPASPLKR

SEQ ID NO: 1398742 - protein, 9 aa, Homo Sapiens
MPSAGTMLS

SEQ ID NO: 1398743 - protein, 9 aa, Homo Sapiens
TPQPRPSRA

SEQ ID NO: 1398744 - protein, 9 aa, Homo Sapiens
HGVTEGNRL

SEQ ID NO: 1398745 - protein, 9 aa, Homo Sapiens
SRLRDPSLQ

SEQ ID NO: 1398746 - protein, 9 aa, Homo Sapiens
AEQDVKEEA

SEQ ID NO: 1398747 - protein, 9 aa, Homo Sapiens
PRFQMLPSS

SEQ ID NO: 1398748 - protein, 9 aa, Homo Sapiens
LSPASRSLC

SEQ ID NO: 1398749 - protein, 9 aa, Homo Sapiens
LVPKRISIS

SEQ ID NO: 1398750 - protein, 9 aa, Homo Sapiens
RAAIWRRIG

SEQ ID NO: 1398751 - protein, 9 aa, Homo Sapiens
GSSFSWRAG

SEQ ID NO: 1398752 - protein, 9 aa, Homo Sapiens
GWLERAYGR

SEQ ID NO: 1398753 - protein, 9 aa, Homo Sapiens
LNLVAAGFL

SEQ ID NO: 1398754 - protein, 9 aa, Homo Sapiens
CEPLWTIPV

SEQ ID NO: 1398755 - protein, 9 aa, Homo Sapiens
NCCRDVVLM

SEQ ID NO: 1398756 - protein, 9 aa, Homo Sapiens
KKMDLDGML

SEQ ID NO: 1398757 - protein, 9 aa, Homo Sapiens
WDERLPSQQ

SEQ ID NO: 1398758 - protein, 9 aa, Homo Sapiens
QRMHLCQYE

SEQ ID NO: 1398759 - protein, 9 aa, Homo Sapiens
RPHGLQSGC

SEQ ID NO: 1398760 - protein, 9 aa, Homo Sapiens
CSETARTML

SEQ ID NO: 1398761 - protein, 9 aa, Homo Sapiens
LLQLRWPGL

SEQ ID NO: 1398762 - protein, 9 aa, Homo Sapiens
VALTRIACK

SEQ ID NO: 1398763 - protein, 9 aa, Homo Sapiens
LQGHTNRVC

SEQ ID NO: 1398764 - protein, 9 aa, Homo Sapiens
VLKSAGYRS

SEQ ID NO: 1398765 - protein, 9 aa, Homo Sapiens
DCPRTMAGP

SEQ ID NO: 1398766 - protein, 9 aa, Homo Sapiens
AAILRVILE

SEQ ID NO: 1398767 - protein, 9 aa, Homo Sapiens
NGESSWLPE

SEQ ID NO: 1398768 - protein, 9 aa, Homo Sapiens
GWWGNGWWG

SEQ ID NO: 1398769 - protein, 9 aa, Homo Sapiens
DRVTIYSPD

SEQ ID NO: 1398770 - protein, 9 aa, Homo Sapiens
IKSAAMLAV

SEQ ID NO: 1398771 - protein, 9 aa, Homo Sapiens
ESASPAVAV

SEQ ID NO: 1398772 - protein, 9 aa, Homo Sapiens
PSSTGKTGW

SEQ ID NO: 1398773 - protein, 9 aa, Homo Sapiens
GHQELDEVV

SEQ ID NO: 1398774 - protein, 9 aa, Homo Sapiens
SDVLQAIQV

SEQ ID NO: 1398775 - protein, 9 aa, Homo Sapiens
EYSVGSTSG

SEQ ID NO: 1398776 - protein, 9 aa, Homo Sapiens
KNAGPRIKC

SEQ ID NO: 1398777 - protein, 9 aa, Homo Sapiens
ASTSTSVSR

SEQ ID NO: 1398778 - protein, 9 aa, Homo Sapiens
RDSVTKGSV

SEQ ID NO: 1398779 - protein, 9 aa, Homo Sapiens
FQPDLCNVD

SEQ ID NO: 1398780 - protein, 9 aa, Homo Sapiens
TPGSGPSPA

SEQ ID NO: 1398781 - protein, 9 aa, Homo Sapiens
ISLPLRGFL

SEQ ID NO: 1398782 - protein, 9 aa, Homo Sapiens
VNPFLPSMP

SEQ ID NO: 1398783 - protein, 9 aa, Homo Sapiens
RWRLDSSAP

SEQ ID NO: 1398784 - protein, 9 aa, Homo Sapiens
VGSRPLLRT

SEQ ID NO: 1398785 - protein, 9 aa, Homo Sapiens
KMTNVQIAT

SEQ ID NO: 1398786 - protein, 9 aa, Homo Sapiens
GATSPVTWL

SEQ ID NO: 1398787 - protein, 9 aa, Homo Sapiens
WMDRYKIDS

SEQ ID NO: 1398788 - protein, 9 aa, Homo Sapiens
IAEVHAQYE

SEQ ID NO: 1398789 - protein, 9 aa, Homo Sapiens
GVNMDHSIS

SEQ ID NO: 1398790 - protein, 9 aa, Homo Sapiens
QFVACLVLT

SEQ ID NO: 1398791 - protein, 9 aa, Homo Sapiens
REHIHAKGS

SEQ ID NO: 1398792 - protein, 9 aa, Homo Sapiens
LYNFSDGLA

SEQ ID NO: 1398793 - protein, 9 aa, Homo Sapiens
RLKDENAVL

SEQ ID NO: 1398794 - protein, 9 aa, Homo Sapiens
GVKPNECSE

SEQ ID NO: 1398795 - protein, 9 aa, Homo Sapiens
LNAEELNIR

SEQ ID NO: 1398796 - protein, 9 aa, Homo Sapiens
GYHFCVGSL

SEQ ID NO: 1398797 - protein, 9 aa, Homo Sapiens
CYTASIMTL

SEQ ID NO: 1398798 - protein, 9 aa, Homo Sapiens
TQKWCMASM

SEQ ID NO: 1398799 - protein, 9 aa, Homo Sapiens
KGQPIIAAL

SEQ ID NO: 1398800 - protein, 9 aa, Homo Sapiens
EPGGRPWCR

SEQ ID NO: 1398801 - protein, 9 aa, Homo Sapiens
VYASTTGAS

SEQ ID NO: 1398802 - protein, 9 aa, Homo Sapiens
AAGASGWSA

SEQ ID NO: 1398803 - protein, 9 aa, Homo Sapiens
YSIIGSPSV

SEQ ID NO: 1398804 - protein, 9 aa, Homo Sapiens
GLAASFAVS

SEQ ID NO: 1398805 - protein, 9 aa, Homo Sapiens
TTRRDSWPT

SEQ ID NO: 1398806 - protein, 9 aa, Homo Sapiens
LPTRIAWQS

SEQ ID NO: 1398807 - protein, 9 aa, Homo Sapiens
TSKRDGKII

SEQ ID NO: 1398808 - protein, 9 aa, Homo Sapiens
AAWPRGEQE

SEQ ID NO: 1398809 - protein, 9 aa, Homo Sapiens
SCTWNPSQI

SEQ ID NO: 1398810 - protein, 9 aa, Homo Sapiens
ALDILPLQA

SEQ ID NO: 1398811 - protein, 9 aa, Homo Sapiens
FSVMSLVIF

SEQ ID NO: 1398812 - protein, 9 aa, Homo Sapiens
WLVCLYHPT

SEQ ID NO: 1398813 - protein, 9 aa, Homo Sapiens
DSKDLEEEG

SEQ ID NO: 1398814 - protein, 9 aa, Homo Sapiens
WTIPVTVLK

SEQ ID NO: 1398815 - protein, 9 aa, Homo Sapiens
GSHWSRSRG

SEQ ID NO: 1398816 - protein, 9 aa, Homo Sapiens
KSELVNKTR

SEQ ID NO: 1398817 - protein, 9 aa, Homo Sapiens
SGSSFSWRA

SEQ ID NO: 1398818 - protein, 9 aa, Homo Sapiens
AGRTSARRR

SEQ ID NO: 1398819 - protein, 9 aa, Homo Sapiens
KIWFQNWRM

SEQ ID NO: 1398820 - protein, 9 aa, Homo Sapiens
QHPVDDARP

SEQ ID NO: 1398821 - protein, 9 aa, Homo Sapiens
LQHALAQAI

SEQ ID NO: 1398822 - protein, 9 aa, Homo Sapiens
LERAYGRLW

SEQ ID NO: 1398823 - protein, 9 aa, Homo Sapiens
ALYEMPVPA

SEQ ID NO: 1398824 - protein, 9 aa, Homo Sapiens
GGAGCGGGN

SEQ ID NO: 1398825 - protein, 9 aa, Homo Sapiens
VAVQAVQTM

SEQ ID NO: 1398826 - protein, 9 aa, Homo Sapiens
PPHLRQLLH

SEQ ID NO: 1398827 - protein, 9 aa, Homo Sapiens
TPVQTLARS

SEQ ID NO: 1398828 - protein, 9 aa, Homo Sapiens
GCLLPVWPA

SEQ ID NO: 1398829 - protein, 9 aa, Homo Sapiens
CGQHPGDGD

SEQ ID NO: 1398830 - protein, 9 aa, Homo Sapiens
FNCFFTSLF

SEQ ID NO: 1398831 - protein, 9 aa, Homo Sapiens
YELVPILEI

SEQ ID NO: 1398832 - protein, 9 aa, Homo Sapiens
CIHMMPNAV

SEQ ID NO: 1398833 - protein, 9 aa, Homo Sapiens
PALRTLTEY

SEQ ID NO: 1398834 - protein, 9 aa, Homo Sapiens
LLQFFSQTY

SEQ ID NO: 1398835 - protein, 9 aa, Homo Sapiens
QRCATLEPQ

SEQ ID NO: 1398836 - protein, 9 aa, Homo Sapiens
QEVLFHVGS

SEQ ID NO: 1398837 - protein, 9 aa, Homo Sapiens
VNMGGNRSI

SEQ ID NO: 1398838 - protein, 9 aa, Homo Sapiens
GLVAGVGLA

SEQ ID NO: 1398839 - protein, 9 aa, Homo Sapiens
RIACAHYPR

SEQ ID NO: 1398840 - protein, 9 aa, Homo Sapiens
RESLGGWRG

SEQ ID NO: 1398841 - protein, 9 aa, Homo Sapiens
GSLFVENSR

SEQ ID NO: 1398842 - protein, 9 aa, Homo Sapiens
RPRFQMLPS

SEQ ID NO: 1398843 - protein, 9 aa, Homo Sapiens
IIAEVHAQY

SEQ ID NO: 1398844 - protein, 9 aa, Homo Sapiens
GQPGPPGPV

SEQ ID NO: 1398845 - protein, 9 aa, Homo Sapiens
RSWEETPVA

SEQ ID NO: 1398846 - protein, 9 aa, Homo Sapiens
SCSEAASLV

SEQ ID NO: 1398847 - protein, 9 aa, Homo Sapiens
CKNELETEN

SEQ ID NO: 1398848 - protein, 9 aa, Homo Sapiens
PVYIFTRPT

SEQ ID NO: 1398849 - protein, 9 aa, Homo Sapiens
VLSYQDPAG

SEQ ID NO: 1398850 - protein, 9 aa, Homo Sapiens
TSGLWFTSR

SEQ ID NO: 1398851 - protein, 9 aa, Homo Sapiens
LGSRLHSWC

SEQ ID NO: 1398852 - protein, 9 aa, Homo Sapiens
FKRISATTQ

SEQ ID NO: 1398853 - protein, 9 aa, Homo Sapiens
VPGGHAQPE

SEQ ID NO: 1398854 - protein, 9 aa, Homo Sapiens
ITGILVDTS

SEQ ID NO: 1398855 - protein, 9 aa, Homo Sapiens
PPTCPLGSE

SEQ ID NO: 1398856 - protein, 9 aa, Homo Sapiens
LGSPLMSEF

SEQ ID NO: 1398857 - protein, 9 aa, Homo Sapiens
RLHVRRGGC

SEQ ID NO: 1398858 - protein, 9 aa, Homo Sapiens
LARQLMHLR

SEQ ID NO: 1398859 - protein, 9 aa, Homo Sapiens
GTLLSTHRL

SEQ ID NO: 1398860 - protein, 9 aa, Homo Sapiens
SPQTPYCIS

SEQ ID NO: 1398861 - protein, 9 aa, Homo Sapiens
QRLLEVIAS

SEQ ID NO: 1398862 - protein, 9 aa, Homo Sapiens
ELQPPGDCP

SEQ ID NO: 1398863 - protein, 9 aa, Homo Sapiens
KAFCEPLWT

SEQ ID NO: 1398864 - protein, 9 aa, Homo Sapiens
VVDKGKQED

SEQ ID NO: 1398865 - protein, 9 aa, Homo Sapiens
LRNFLIKMG

SEQ ID NO: 1398866 - protein, 9 aa, Homo Sapiens
HLRQLLHGR

SEQ ID NO: 1398867 - protein, 9 aa, Homo Sapiens
FPLPRASLR

SEQ ID NO: 1398868 - protein, 9 aa, Homo Sapiens
KNIPGIRGA

SEQ ID NO: 1398869 - protein, 9 aa, Homo Sapiens
LFKSRKAYL

SEQ ID NO: 1398870 - protein, 9 aa, Homo Sapiens
EGKAFLPER

SEQ ID NO: 1398871 - protein, 9 aa, Homo Sapiens
PEPEKERRP

SEQ ID NO: 1398872 - protein, 9 aa, Homo Sapiens
RFQMLPSSC

SEQ ID NO: 1398873 - protein, 9 aa, Homo Sapiens
STGDVDGPG

SEQ ID NO: 1398874 - protein, 9 aa, Homo Sapiens
GSLFKSRKA

SEQ ID NO: 1398875 - protein, 9 aa, Homo Sapiens
VRDSVTKGS

SEQ ID NO: 1398876 - protein, 9 aa, Homo Sapiens
HNAKDVSVS

SEQ ID NO: 1398877 - protein, 9 aa, Homo Sapiens
FFHFPHCSE

SEQ ID NO: 1398878 - protein, 9 aa, Homo Sapiens
CRLWCFPQP

SEQ ID NO: 1398879 - protein, 9 aa, Homo Sapiens
ELLKKCSLY

SEQ ID NO: 1398880 - protein, 9 aa, Homo Sapiens
KYRTAHAMR

SEQ ID NO: 1398881 - protein, 9 aa, Homo Sapiens
NAVLIRVIS

SEQ ID NO: 1398882 - protein, 9 aa, Homo Sapiens
AAGFLFLSG

SEQ ID NO: 1398883 - protein, 9 aa, Homo Sapiens
VLQAAWPRG

SEQ ID NO: 1398884 - protein, 9 aa, Homo Sapiens
HLKPSGEQI

SEQ ID NO: 1398885 - protein, 9 aa, Homo Sapiens
FLPERKCFP

SEQ ID NO: 1398886 - protein, 9 aa, Homo Sapiens
ARQLMHLRG

SEQ ID NO: 1398887 - protein, 9 aa, Homo Sapiens
QKREKKNQK

SEQ ID NO: 1398888 - protein, 9 aa, Homo Sapiens
LSPQWATIN

SEQ ID NO: 1398889 - protein, 9 aa, Homo Sapiens
DCCLRLKVT

SEQ ID NO: 1398890 - protein, 9 aa, Homo Sapiens
VHLVLHRLL

SEQ ID NO: 1398891 - protein, 9 aa, Homo Sapiens
PTMAAAPHT

SEQ ID NO: 1398892 - protein, 9 aa, Homo Sapiens
GSPAKAEQR

SEQ ID NO: 1398893 - protein, 9 aa, Homo Sapiens
SEAERLEAH

SEQ ID NO: 1398894 - protein, 9 aa, Homo Sapiens
ISATTQCCW

SEQ ID NO: 1398895 - protein, 9 aa, Homo Sapiens
EAAIHTKLE

SEQ ID NO: 1398896 - protein, 9 aa, Homo Sapiens
SPSPPGAPL

SEQ ID NO: 1398897 - protein, 9 aa, Homo Sapiens
GLQILHPYN

SEQ ID NO: 1398898 - protein, 9 aa, Homo Sapiens
LDPDIGGSG

SEQ ID NO: 1398899 - protein, 9 aa, Homo Sapiens
PHLLLMKRP

SEQ ID NO: 1398900 - protein, 9 aa, Homo Sapiens
SPVTWLISL

SEQ ID NO: 1398901 - protein, 9 aa, Homo Sapiens
ATSGTAPSA

SEQ ID NO: 1398902 - protein, 9 aa, Homo Sapiens
NHLEIWSVN

SEQ ID NO: 1398903 - protein, 9 aa, Homo Sapiens
QKGKKRGKR

SEQ ID NO: 1398904 - protein, 9 aa, Homo Sapiens
IYLQTTDYG

SEQ ID NO: 1398905 - protein, 9 aa, Homo Sapiens
QPDLAPGLI

SEQ ID NO: 1398906 - protein, 9 aa, Homo Sapiens
AAQCPLLDC

SEQ ID NO: 1398907 - protein, 9 aa, Homo Sapiens
LCHLASGRG

SEQ ID NO: 1398908 - protein, 9 aa, Homo Sapiens
KQEEEEGIY

SEQ ID NO: 1398909 - protein, 9 aa, Homo Sapiens
VLCLALGSR

SEQ ID NO: 1398910 - protein, 9 aa, Homo Sapiens
YSGSGSGCG

SEQ ID NO: 1398911 - protein, 9 aa, Homo Sapiens
TPEGYDHPL

SEQ ID NO: 1398912 - protein, 9 aa, Homo Sapiens
KKRKKMFLI

SEQ ID NO: 1398913 - protein, 9 aa, Homo Sapiens
GYELVPILE

SEQ ID NO: 1398914 - protein, 9 aa, Homo Sapiens
AEQRFVQGH

SEQ ID NO: 1398915 - protein, 9 aa, Homo Sapiens
FCVGSLINE

SEQ ID NO: 1398916 - protein, 9 aa, Homo Sapiens
YTNPAVTAT

SEQ ID NO: 1398917 - protein, 9 aa, Homo Sapiens
RCCPPGHPC

SEQ ID NO: 1398918 - protein, 9 aa, Homo Sapiens
PAPAASMRP

SEQ ID NO: 1398919 - protein, 9 aa, Homo Sapiens
SPTARATSG

SEQ ID NO: 1398920 - protein, 9 aa, Homo Sapiens
RPLSSKLGI

SEQ ID NO: 1398921 - protein, 9 aa, Homo Sapiens
VARGMGGSL

SEQ ID NO: 1398922 - protein, 9 aa, Homo Sapiens
FILSVALDI

SEQ ID NO: 1398923 - protein, 9 aa, Homo Sapiens
PLVVLCLTS

SEQ ID NO: 1398924 - protein, 9 aa, Homo Sapiens
VMPRTLEGC

SEQ ID NO: 1398925 - protein, 9 aa, Homo Sapiens
STFEENMHV

SEQ ID NO: 1398926 - protein, 9 aa, Homo Sapiens
TSSMPEQVH

SEQ ID NO: 1398927 - protein, 9 aa, Homo Sapiens
SDNDAGALS

SEQ ID NO: 1398928 - protein, 9 aa, Homo Sapiens
VWSLLNWTF

SEQ ID NO: 1398929 - protein, 9 aa, Homo Sapiens
EHFSLRNCI

SEQ ID NO: 1398930 - protein, 9 aa, Homo Sapiens
CDYILPVLL

SEQ ID NO: 1398931 - protein, 9 aa, Homo Sapiens
PSAFDRNFG

SEQ ID NO: 1398932 - protein, 9 aa, Homo Sapiens
AQLAGRRVW

SEQ ID NO: 1398933 - protein, 9 aa, Homo Sapiens
HFPHCSETA

SEQ ID NO: 1398934 - protein, 9 aa, Homo Sapiens
YFQQMSSWA

SEQ ID NO: 1398935 - protein, 9 aa, Homo Sapiens
KKNLPVQPV

SEQ ID NO: 1398936 - protein, 9 aa, Homo Sapiens
GVCHLCLEP

SEQ ID NO: 1398937 - protein, 9 aa, Homo Sapiens
TVPRHSSVL

SEQ ID NO: 1398938 - protein, 9 aa, Homo Sapiens
SWMGARGPT

SEQ ID NO: 1398939 - protein, 9 aa, Homo Sapiens
ANRYRSLVH

SEQ ID NO: 1398940 - protein, 9 aa, Homo Sapiens
SFPLLITSS

SEQ ID NO: 1398941 - protein, 9 aa, Homo Sapiens
MENSHPPTT

SEQ ID NO: 1398942 - protein, 9 aa, Homo Sapiens
FTEAWGARR

SEQ ID NO: 1398943 - protein, 9 aa, Homo Sapiens
EHTVSEFIK

SEQ ID NO: 1398944 - protein, 9 aa, Homo Sapiens
GTMLSERSA

SEQ ID NO: 1398945 - protein, 9 aa, Homo Sapiens
CPEQFAHGV

SEQ ID NO: 1398946 - protein, 9 aa, Homo Sapiens
HQPLPGQHL

SEQ ID NO: 1398947 - protein, 9 aa, Homo Sapiens
TREAISRIC

SEQ ID NO: 1398948 - protein, 9 aa, Homo Sapiens
PEVIEDFLR

SEQ ID NO: 1398949 - protein, 9 aa, Homo Sapiens
KKPWKNSES

SEQ ID NO: 1398950 - protein, 9 aa, Homo Sapiens
RNFLIKMGM

SEQ ID NO: 1398951 - protein, 9 aa, Homo Sapiens
PCSAACRWP

SEQ ID NO: 1398952 - protein, 9 aa, Homo Sapiens
FKCYDAQLY

SEQ ID NO: 1398953 - protein, 9 aa, Homo Sapiens
ASQDTALAF

SEQ ID NO: 1398954 - protein, 9 aa, Homo Sapiens
FLLVALSLD

SEQ ID NO: 1398955 - protein, 9 aa, Homo Sapiens
FGTMPLLHI

SEQ ID NO: 1398956 - protein, 9 aa, Homo Sapiens
PIIAALYEM

SEQ ID NO: 1398957 - protein, 9 aa, Homo Sapiens
SSAQVEQLC

SEQ ID NO: 1398958 - protein, 9 aa, Homo Sapiens
SPGPRMGPV

SEQ ID NO: 1398959 - protein, 9 aa, Homo Sapiens
ALILVTGQM

SEQ ID NO: 1398960 - protein, 9 aa, Homo Sapiens
AQSRMHWRA

SEQ ID NO: 1398961 - protein, 9 aa, Homo Sapiens
VAIFVMCWL

SEQ ID NO: 1398962 - protein, 9 aa, Homo Sapiens
MRPFLAKEC

SEQ ID NO: 1398963 - protein, 9 aa, Homo Sapiens
GYPVVDKGK

SEQ ID NO: 1398964 - protein, 9 aa, Homo Sapiens
AVLIRVISK

SEQ ID NO: 1398965 - protein, 9 aa, Homo Sapiens
ERLEAHFQD

SEQ ID NO: 1398966 - protein, 9 aa, Homo Sapiens
LHGVTEGNR

SEQ ID NO: 1398967 - protein, 9 aa, Homo Sapiens
PWCRESLGG

SEQ ID NO: 1398968 - protein, 9 aa, Homo Sapiens
QEDVASTTH

SEQ ID NO: 1398969 - protein, 9 aa, Homo Sapiens
VNISRVELT

SEQ ID NO: 1398970 - protein, 9 aa, Homo Sapiens
GSGKSNFFM

SEQ ID NO: 1398971 - protein, 9 aa, Homo Sapiens
SNVAIPANS

SEQ ID NO: 1398972 - protein, 9 aa, Homo Sapiens
GAHSSHQAY

SEQ ID NO: 1398973 - protein, 9 aa, Homo Sapiens
WRMKMKKMN

SEQ ID NO: 1398974 - protein, 9 aa, Homo Sapiens
QRPIQVQTG

SEQ ID NO: 1398975 - protein, 9 aa, Homo Sapiens
WQGLKAAIK

SEQ ID NO: 1398976 - protein, 9 aa, Homo Sapiens
NRYIEKSNS

SEQ ID NO: 1398977 - protein, 9 aa, Homo Sapiens
SNWKKPWKN

SEQ ID NO: 1398978 - protein, 9 aa, Homo Sapiens
SLFKSRKAY

SEQ ID NO: 1398979 - protein, 9 aa, Homo Sapiens
TLSLFYTYK

SEQ ID NO: 1398980 - protein, 9 aa, Homo Sapiens
RARSVEQGC

SEQ ID NO: 1398981 - protein, 9 aa, Homo Sapiens
FDIDRERRA

SEQ ID NO: 1398982 - protein, 9 aa, Homo Sapiens
CGPTSGSTP

SEQ ID NO: 1398983 - protein, 9 aa, Homo Sapiens
QVEIAEKMF

SEQ ID NO: 1398984 - protein, 9 aa, Homo Sapiens
SLLDDANLC

SEQ ID NO: 1398985 - protein, 9 aa, Homo Sapiens
EKWMDRYKI

SEQ ID NO: 1398986 - protein, 9 aa, Homo Sapiens
MQAVWQDPL

SEQ ID NO: 1398987 - protein, 9 aa, Homo Sapiens
TQESSILSS

SEQ ID NO: 1398988 - protein, 9 aa, Homo Sapiens
DCPKRPEQL

SEQ ID NO: 1398989 - protein, 9 aa, Homo Sapiens
MCAACGPGP

SEQ ID NO: 1398990 - protein, 9 aa, Homo Sapiens
RTESLNRYI

SEQ ID NO: 1398991 - protein, 9 aa, Homo Sapiens
RLYSRAVLV

SEQ ID NO: 1398992 - protein, 9 aa, Homo Sapiens
DLPATLCLL

SEQ ID NO: 1398993 - protein, 9 aa, Homo Sapiens
PPAQPALRP

SEQ ID NO: 1398994 - protein, 9 aa, Homo Sapiens
PTLPWTLRK

SEQ ID NO: 1398995 - protein, 9 aa, Homo Sapiens
KRSKKVSTR

SEQ ID NO: 1398996 - protein, 9 aa, Homo Sapiens
PQSSSSSRP

SEQ ID NO: 1398997 - protein, 9 aa, Homo Sapiens
ARGCRNYPN

SEQ ID NO: 1398998 - protein, 9 aa, Homo Sapiens
PSKALHGVT

SEQ ID NO: 1398999 - protein, 9 aa, Homo Sapiens
GPRAIDGHR

SEQ ID NO: 1399000 - protein, 9 aa, Homo Sapiens
SAQLAGRRV

SEQ ID NO: 1399001 - protein, 9 aa, Homo Sapiens
CGCTLQYQH

SEQ ID NO: 1399002 - protein, 9 aa, Homo Sapiens
YTRFAAYIF

SEQ ID NO: 1399003 - protein, 9 aa, Homo Sapiens
VAGMPGGLA

SEQ ID NO: 1399004 - protein, 9 aa, Homo Sapiens
CRECDKAFN

SEQ ID NO: 1399005 - protein, 9 aa, Homo Sapiens
GRSVRPPVT

SEQ ID NO: 1399006 - protein, 9 aa, Homo Sapiens
LNFSVIVAN

SEQ ID NO: 1399007 - protein, 9 aa, Homo Sapiens
PQWMHACGG

SEQ ID NO: 1399008 - protein, 9 aa, Homo Sapiens
GSGPSPAPS

SEQ ID NO: 1399009 - protein, 9 aa, Homo Sapiens
MAGPSASLH

SEQ ID NO: 1399010 - protein, 9 aa, Homo Sapiens
ISSQTRYAQ

SEQ ID NO: 1399011 - protein, 9 aa, Homo Sapiens
FLQLQGLVA

SEQ ID NO: 1399012 - protein, 9 aa, Homo Sapiens
NVRDKKKGQ

SEQ ID NO: 1399013 - protein, 9 aa, Homo Sapiens
LQHPVDDAR

SEQ ID NO: 1399014 - protein, 9 aa, Homo Sapiens
IPEGFQDKR

SEQ ID NO: 1399015 - protein, 9 aa, Homo Sapiens
GPSPARSAA

SEQ ID NO: 1399016 - protein, 9 aa, Homo Sapiens
LSSTLWNFC

SEQ ID NO: 1399017 - protein, 9 aa, Homo Sapiens
SKVVHIMTC

SEQ ID NO: 1399018 - protein, 9 aa, Homo Sapiens
KFFLQLQGL

SEQ ID NO: 1399019 - protein, 9 aa, Homo Sapiens
IDRYRGPPG

SEQ ID NO: 1399020 - protein, 9 aa, Homo Sapiens
PGSGPSPAP

SEQ ID NO: 1399021 - protein, 9 aa, Homo Sapiens
GMGRPPAAS

SEQ ID NO: 1399022 - protein, 9 aa, Homo Sapiens
LTRLMRRNS

SEQ ID NO: 1399023 - protein, 9 aa, Homo Sapiens
WSPCSAACR

SEQ ID NO: 1399024 - protein, 9 aa, Homo Sapiens
GAVQILTLY

SEQ ID NO: 1399025 - protein, 9 aa, Homo Sapiens
DQGPDKENP

SEQ ID NO: 1399026 - protein, 9 aa, Homo Sapiens
AKAEQRFVQ

SEQ ID NO: 1399027 - protein, 9 aa, Homo Sapiens
KYTTESSDT

SEQ ID NO: 1399028 - protein, 9 aa, Homo Sapiens
MPMYQVKTY

SEQ ID NO: 1399029 - protein, 9 aa, Homo Sapiens
SLILGAWIN

SEQ ID NO: 1399030 - protein, 9 aa, Homo Sapiens
SFPEYMFNS

SEQ ID NO: 1399031 - protein, 9 aa, Homo Sapiens
RVQAQVYFT

SEQ ID NO: 1399032 - protein, 9 aa, Homo Sapiens
EVCGTGVRT

SEQ ID NO: 1399033 - protein, 9 aa, Homo Sapiens
PVDAGRYEC

SEQ ID NO: 1399034 - protein, 9 aa, Homo Sapiens
TEPYCIIAA

SEQ ID NO: 1399035 - protein, 9 aa, Homo Sapiens
QVPVQPEVT

SEQ ID NO: 1399036 - protein, 9 aa, Homo Sapiens
VEQLCQAIE

SEQ ID NO: 1399037 - protein, 9 aa, Homo Sapiens
AIPKKAFCE

SEQ ID NO: 1399038 - protein, 9 aa, Homo Sapiens
PQTILLAYG

SEQ ID NO: 1399039 - protein, 9 aa, Homo Sapiens
ARTAVIRED

SEQ ID NO: 1399040 - protein, 9 aa, Homo Sapiens
MVIMGDGLY

SEQ ID NO: 1399041 - protein, 9 aa, Homo Sapiens
LKPSGEQIP

SEQ ID NO: 1399042 - protein, 9 aa, Homo Sapiens
STTRVPDEA

SEQ ID NO: 1399043 - protein, 9 aa, Homo Sapiens
GPSVTCGPT

SEQ ID NO: 1399044 - protein, 9 aa, Homo Sapiens
NKIRIFKER

SEQ ID NO: 1399045 - protein, 9 aa, Homo Sapiens
NKTRWQYYG

SEQ ID NO: 1399046 - protein, 9 aa, Homo Sapiens
IKRGPSQLP

SEQ ID NO: 1399047 - protein, 9 aa, Homo Sapiens
LFEKAAPRP

SEQ ID NO: 1399048 - protein, 9 aa, Homo Sapiens
VCGTGVRTC

SEQ ID NO: 1399049 - protein, 9 aa, Homo Sapiens
VLSPIECTE

SEQ ID NO: 1399050 - protein, 9 aa, Homo Sapiens
SWNRLREGQ

SEQ ID NO: 1399051 - protein, 9 aa, Homo Sapiens
FLTQKWCMA

SEQ ID NO: 1399052 - protein, 9 aa, Homo Sapiens
VESHPHGSP

SEQ ID NO: 1399053 - protein, 9 aa, Homo Sapiens
FVLPVGAMV

SEQ ID NO: 1399054 - protein, 9 aa, Homo Sapiens
SPPGAPLPK

SEQ ID NO: 1399055 - protein, 9 aa, Homo Sapiens
PIQVQTGGR

SEQ ID NO: 1399056 - protein, 9 aa, Homo Sapiens
VTVLKSAGY

SEQ ID NO: 1399057 - protein, 9 aa, Homo Sapiens
NGLLGAQAK

SEQ ID NO: 1399058 - protein, 9 aa, Homo Sapiens
LEQFMENEG

SEQ ID NO: 1399059 - protein, 9 aa, Homo Sapiens
KERAQSAEE

SEQ ID NO: 1399060 - protein, 9 aa, Homo Sapiens
HTVRIWDLA

SEQ ID NO: 1399061 - protein, 9 aa, Homo Sapiens
SYWTSWRTK

SEQ ID NO: 1399062 - protein, 9 aa, Homo Sapiens
RTPPKITSP

SEQ ID NO: 1399063 - protein, 9 aa, Homo Sapiens
PNKPPLRTT

SEQ ID NO: 1399064 - protein, 9 aa, Homo Sapiens
ERQEILPDE

SEQ ID NO: 1399065 - protein, 9 aa, Homo Sapiens
SVLATGLHL

SEQ ID NO: 1399066 - protein, 9 aa, Homo Sapiens
RSVRPPVTT

SEQ ID NO: 1399067 - protein, 9 aa, Homo Sapiens
PSVLSQVQL

SEQ ID NO: 1399068 - protein, 9 aa, Homo Sapiens
AVLLGYPVV

SEQ ID NO: 1399069 - protein, 9 aa, Homo Sapiens
QFSLFSVMS

SEQ ID NO: 1399070 - protein, 9 aa, Homo Sapiens
LVVCRSRSL

SEQ ID NO: 1399071 - protein, 9 aa, Homo Sapiens
ARRERPSNP

SEQ ID NO: 1399072 - protein, 9 aa, Homo Sapiens
SPKARVSFW

SEQ ID NO: 1399073 - protein, 9 aa, Homo Sapiens
EKCYEGTCS

SEQ ID NO: 1399074 - protein, 9 aa, Homo Sapiens
EAALQIPLT

SEQ ID NO: 1399075 - protein, 9 aa, Homo Sapiens
KFSCHIRAG

SEQ ID NO: 1399076 - protein, 9 aa, Homo Sapiens
ASAPEVPAT

SEQ ID NO: 1399077 - protein, 9 aa, Homo Sapiens
TVLKSAGYR

SEQ ID NO: 1399078 - protein, 9 aa, Homo Sapiens
PSCVPTAAR

SEQ ID NO: 1399079 - protein, 9 aa, Homo Sapiens
DGLEQDLQH

SEQ ID NO: 1399080 - protein, 9 aa, Homo Sapiens
TIVLQHEYG

SEQ ID NO: 1399081 - protein, 9 aa, Homo Sapiens
SFWSVWPVE

SEQ ID NO: 1399082 - protein, 9 aa, Homo Sapiens
LGDGLDPNS

SEQ ID NO: 1399083 - protein, 9 aa, Homo Sapiens
EECVKAFKH

SEQ ID NO: 1399084 - protein, 9 aa, Homo Sapiens
ELVKLESCK

SEQ ID NO: 1399085 - protein, 9 aa, Homo Sapiens
VMQFHFLSW

SEQ ID NO: 1399086 - protein, 9 aa, Homo Sapiens
GRGIEGLIF

SEQ ID NO: 1399087 - protein, 9 aa, Homo Sapiens
PCKCEECVK

SEQ ID NO: 1399088 - protein, 9 aa, Homo Sapiens
EIDVQTAFF

SEQ ID NO: 1399089 - protein, 9 aa, Homo Sapiens
VCHPHGLFV

SEQ ID NO: 1399090 - protein, 9 aa, Homo Sapiens
NVLKQICPG

SEQ ID NO: 1399091 - protein, 9 aa, Homo Sapiens
MSAFQNHCP

SEQ ID NO: 1399092 - protein, 9 aa, Homo Sapiens
VPQPGKKSE

SEQ ID NO: 1399093 - protein, 9 aa, Homo Sapiens
WGSGLLSRN

SEQ ID NO: 1399094 - protein, 9 aa, Homo Sapiens
VFTSGLTYI

SEQ ID NO: 1399095 - protein, 9 aa, Homo Sapiens
ERFGRKFVL

SEQ ID NO: 1399096 - protein, 9 aa, Homo Sapiens
LSYVPALKP

SEQ ID NO: 1399097 - protein, 9 aa, Homo Sapiens
PNSVSLASV

SEQ ID NO: 1399098 - protein, 9 aa, Homo Sapiens
AQAPHFQVS

SEQ ID NO: 1399099 - protein, 9 aa, Homo Sapiens
RNKVNESWK

SEQ ID NO: 1399100 - protein, 9 aa, Homo Sapiens
RTVMQFHFL

SEQ ID NO: 1399101 - protein, 9 aa, Homo Sapiens
TVMQFHFLS

SEQ ID NO: 1399102 - protein, 9 aa, Homo Sapiens
SNTELIVRV

SEQ ID NO: 1399103 - protein, 9 aa, Homo Sapiens
FSWQSVLLS

SEQ ID NO: 1399104 - protein, 9 aa, Homo Sapiens
HCMHLHEKR

SEQ ID NO: 1399105 - protein, 9 aa, Homo Sapiens
QVPMKSSTQ

SEQ ID NO: 1399106 - protein, 9 aa, Homo Sapiens
VVIMCLLAI

SEQ ID NO: 1399107 - protein, 9 aa, Homo Sapiens
ATPPKKMGS

SEQ ID NO: 1399108 - protein, 9 aa, Homo Sapiens
TATPPKKMG

SEQ ID NO: 1399109 - protein, 9 aa, Homo Sapiens
ESMMHEEHL

SEQ ID NO: 1399110 - protein, 9 aa, Homo Sapiens
GTSSKLYVK

SEQ ID NO: 1399111 - protein, 9 aa, Homo Sapiens
MVIDINDHS

SEQ ID NO: 1399112 - protein, 9 aa, Homo Sapiens
AVRHGAVTD

SEQ ID NO: 1399113 - protein, 9 aa, Homo Sapiens
SEKPGQEAT

SEQ ID NO: 1399114 - protein, 9 aa, Homo Sapiens
STPVFTSGL

SEQ ID NO: 1399115 - protein, 9 aa, Homo Sapiens
SMMHEEHLR

SEQ ID NO: 1399116 - protein, 9 aa, Homo Sapiens
TPNEELLEA

SEQ ID NO: 1399117 - protein, 9 aa, Homo Sapiens
TSSIVKSNR

SEQ ID NO: 1399118 - protein, 9 aa, Homo Sapiens
PKVNSKGLP

SEQ ID NO: 1399119 - protein, 9 aa, Homo Sapiens
LYGHTSTVH

SEQ ID NO: 1399120 - protein, 9 aa, Homo Sapiens
STVHCMHLH

SEQ ID NO: 1399121 - protein, 9 aa, Homo Sapiens
FEEAESLGY

SEQ ID NO: 1399122 - protein, 9 aa, Homo Sapiens
IVKSNRRQN

SEQ ID NO: 1399123 - protein, 9 aa, Homo Sapiens
DGLDPNSVS

SEQ ID NO: 1399124 - protein, 9 aa, Homo Sapiens
GAGLFLYFR

SEQ ID NO: 1399125 - protein, 9 aa, Homo Sapiens
GRSGETSHT

SEQ ID NO: 1399126 - protein, 9 aa, Homo Sapiens
QNHCPHLDS

SEQ ID NO: 1399127 - protein, 9 aa, Homo Sapiens
SSVWTISIN

SEQ ID NO: 1399128 - protein, 9 aa, Homo Sapiens
ENYEMTLKS

SEQ ID NO: 1399129 - protein, 9 aa, Homo Sapiens
VFEEIPGEF

SEQ ID NO: 1399130 - protein, 9 aa, Homo Sapiens
YNERNKVNE

SEQ ID NO: 1399131 - protein, 9 aa, Homo Sapiens
EGNLRVECL

SEQ ID NO: 1399132 - protein, 9 aa, Homo Sapiens
PSGAWLGPL

SEQ ID NO: 1399133 - protein, 9 aa, Homo Sapiens
HQFNPTVVY

SEQ ID NO: 1399134 - protein, 9 aa, Homo Sapiens
TISWRTGRN

SEQ ID NO: 1399135 - protein, 9 aa, Homo Sapiens
ERNKVNESW

SEQ ID NO: 1399136 - protein, 9 aa, Homo Sapiens
LHRELHAQA

SEQ ID NO: 1399137 - protein, 9 aa, Homo Sapiens
ESCKLIEEV

SEQ ID NO: 1399138 - protein, 9 aa, Homo Sapiens
GQEATVLPK

SEQ ID NO: 1399139 - protein, 9 aa, Homo Sapiens
FNLGRGIEG

SEQ ID NO: 1399140 - protein, 9 aa, Homo Sapiens
FVALGEFLY

SEQ ID NO: 1399141 - protein, 9 aa, Homo Sapiens
VFKNMPSNT

SEQ ID NO: 1399142 - protein, 9 aa, Homo Sapiens
ALLDELEKK

SEQ ID NO: 1399143 - protein, 9 aa, Homo Sapiens
ELMVIDIND

SEQ ID NO: 1399144 - protein, 9 aa, Homo Sapiens
KGDGGIQGV

SEQ ID NO: 1399145 - protein, 9 aa, Homo Sapiens
LMVIDINDH

SEQ ID NO: 1399146 - protein, 9 aa, Homo Sapiens
HHLHRARCT

SEQ ID NO: 1399147 - protein, 9 aa, Homo Sapiens
EEASPQVLP

SEQ ID NO: 1399148 - protein, 9 aa, Homo Sapiens
YVPALKPFG

SEQ ID NO: 1399149 - protein, 9 aa, Homo Sapiens
TQRRSVQGR

SEQ ID NO: 1399150 - protein, 9 aa, Homo Sapiens
SGLLSRNHS

SEQ ID NO: 1399151 - protein, 9 aa, Homo Sapiens
SLGYVDVGL

SEQ ID NO: 1399152 - protein, 9 aa, Homo Sapiens
VMIVLGAGD

SEQ ID NO: 1399153 - protein, 9 aa, Homo Sapiens
DLMKQILCL

SEQ ID NO: 1399154 - protein, 9 aa, Homo Sapiens
EARPWNLTW

SEQ ID NO: 1399155 - protein, 9 aa, Homo Sapiens
NETRTVMQF

SEQ ID NO: 1399156 - protein, 9 aa, Homo Sapiens
QFSTAVVIM

SEQ ID NO: 1399157 - protein, 9 aa, Homo Sapiens
PGQEATVLP

SEQ ID NO: 1399158 - protein, 9 aa, Homo Sapiens
GLFLYFRNQ

SEQ ID NO: 1399159 - protein, 9 aa, Homo Sapiens
FVFEEIPGE

SEQ ID NO: 1399160 - protein, 9 aa, Homo Sapiens
GLAVRHGAV

SEQ ID NO: 1399161 - protein, 9 aa, Homo Sapiens
EATVLPKDG

SEQ ID NO: 1399162 - protein, 9 aa, Homo Sapiens
LESCKLIEE

SEQ ID NO: 1399163 - protein, 9 aa, Homo Sapiens
KEHRWGSGL

SEQ ID NO: 1399164 - protein, 9 aa, Homo Sapiens
GGTMRGTSG

SEQ ID NO: 1399165 - protein, 9 aa, Homo Sapiens
SFLPHEIPL

SEQ ID NO: 1399166 - protein, 9 aa, Homo Sapiens
MTLKSDTNG

SEQ ID NO: 1399167 - protein, 9 aa, Homo Sapiens
QSVLLSHQR

SEQ ID NO: 1399168 - protein, 9 aa, Homo Sapiens
GHTSTVHCM

SEQ ID NO: 1399169 - protein, 9 aa, Homo Sapiens
TVHCMHLHE

SEQ ID NO: 1399170 - protein, 9 aa, Homo Sapiens
IPNKMSAFQ

SEQ ID NO: 1399171 - protein, 9 aa, Homo Sapiens
PQPGKKSEE

SEQ ID NO: 1399172 - protein, 9 aa, Homo Sapiens
TSFLPHEIP

SEQ ID NO: 1399173 - protein, 9 aa, Homo Sapiens
TAVVIMCLL

SEQ ID NO: 1399174 - protein, 9 aa, Homo Sapiens
VKSNRRQNP

SEQ ID NO: 1399175 - protein, 9 aa, Homo Sapiens
PAKRVRLPP

SEQ ID NO: 1399176 - protein, 9 aa, Homo Sapiens
NDVDKDLMK

SEQ ID NO: 1399177 - protein, 9 aa, Homo Sapiens
HLHRARCTD

SEQ ID NO: 1399178 - protein, 9 aa, Homo Sapiens
NLRVECLDD

SEQ ID NO: 1399179 - protein, 9 aa, Homo Sapiens
RDTQNQDAP

SEQ ID NO: 1399180 - protein, 9 aa, Homo Sapiens
SWQSVLLSH

SEQ ID NO: 1399181 - protein, 9 aa, Homo Sapiens
YREAMESMM

SEQ ID NO: 1399182 - protein, 9 aa, Homo Sapiens
LKYENYEMT

SEQ ID NO: 1399183 - protein, 9 aa, Homo Sapiens
YASSVWTIS

SEQ ID NO: 1399184 - protein, 9 aa, Homo Sapiens
KSEEASPQV

SEQ ID NO: 1399185 - protein, 9 aa, Homo Sapiens
YGHLSERFG

SEQ ID NO: 1399186 - protein, 9 aa, Homo Sapiens
GLDPNSVSL

SEQ ID NO: 1399187 - protein, 9 aa, Homo Sapiens
GYNERNKVN

SEQ ID NO: 1399188 - protein, 9 aa, Homo Sapiens
AFQNHCPHL

SEQ ID NO: 1399189 - protein, 9 aa, Homo Sapiens
EIPLLEGME

SEQ ID NO: 1399190 - protein, 9 aa, Homo Sapiens
PPTVFRWTG

SEQ ID NO: 1399191 - protein, 9 aa, Homo Sapiens
PVFTSGLTY

SEQ ID NO: 1399192 - protein, 9 aa, Homo Sapiens
RWGSGLLSR

SEQ ID NO: 1399193 - protein, 9 aa, Homo Sapiens
RPWNLTWID

SEQ ID NO: 1399194 - protein, 9 aa, Homo Sapiens
CGGTMRGTS

SEQ ID NO: 1399195 - protein, 9 aa, Homo Sapiens
PAQAPPTVF

SEQ ID NO: 1399196 - protein, 9 aa, Homo Sapiens
IFQAELMVI

SEQ ID NO: 1399197 - protein, 9 aa, Homo Sapiens
TNTKGNKQS

SEQ ID NO: 1399198 - protein, 9 aa, Homo Sapiens
NLGRGIEGL

SEQ ID NO: 1399199 - protein, 9 aa, Homo Sapiens
VDKDLMKQI

SEQ ID NO: 1399200 - protein, 9 aa, Homo Sapiens
AGLFLYFRN

SEQ ID NO: 1399201 - protein, 9 aa, Homo Sapiens
VNSKGLPTG

SEQ ID NO: 1399202 - protein, 9 aa, Homo Sapiens
LYGHLSERF

SEQ ID NO: 1399203 - protein, 9 aa, Homo Sapiens
TKGNKQSRT

SEQ ID NO: 1399204 - protein, 9 aa, Homo Sapiens
GHFNLGRGI

SEQ ID NO: 1399205 - protein, 9 aa, Homo Sapiens
CKCEECVKA

SEQ ID NO: 1399206 - protein, 9 aa, Homo Sapiens
VRIMKKNVP

SEQ ID NO: 1399207 - protein, 9 aa, Homo Sapiens
LMARDTQNQ

SEQ ID NO: 1399208 - protein, 9 aa, Homo Sapiens
WNMTATPPK

SEQ ID NO: 1399209 - protein, 9 aa, Homo Sapiens
FSTAVVIMC

SEQ ID NO: 1399210 - protein, 9 aa, Homo Sapiens
SIRGVMIVL

SEQ ID NO: 1399211 - protein, 9 aa, Homo Sapiens
PLSTPVFTS

SEQ ID NO: 1399212 - protein, 9 aa, Homo Sapiens
KMSAFQNHC

SEQ ID NO: 1399213 - protein, 9 aa, Homo Sapiens
FTSGLTYIK

SEQ ID NO: 1399214 - protein, 9 aa, Homo Sapiens
SSKLYVKDF

SEQ ID NO: 1399215 - protein, 9 aa, Homo Sapiens
TPPKKMGSQ

SEQ ID NO: 1399216 - protein, 9 aa, Homo Sapiens
MIVLGAGDT

SEQ ID NO: 1399217 - protein, 9 aa, Homo Sapiens
HAQAPHFQV

SEQ ID NO: 1399218 - protein, 9 aa, Homo Sapiens
ICPGVENAQ

SEQ ID NO: 1399219 - protein, 9 aa, Homo Sapiens
RARCTDVDE

SEQ ID NO: 1399220 - protein, 9 aa, Homo Sapiens
RNRLRCGGT

SEQ ID NO: 1399221 - protein, 9 aa, Homo Sapiens
GYASSVWTI

SEQ ID NO: 1399222 - protein, 9 aa, Homo Sapiens
LKQICPGVE

SEQ ID NO: 1399223 - protein, 9 aa, Homo Sapiens
RELHAQAPH

SEQ ID NO: 1399224 - protein, 9 aa, Homo Sapiens
LSTPVFTSG

SEQ ID NO: 1399225 - protein, 9 aa, Homo Sapiens
HTVGRSGET

SEQ ID NO: 1399226 - protein, 9 aa, Homo Sapiens
LTQRRSVQG

SEQ ID NO: 1399227 - protein, 9 aa, Homo Sapiens
AQAPPTVFR

SEQ ID NO: 1399228 - protein, 9 aa, Homo Sapiens
FDVAIIAGP

SEQ ID NO: 1399229 - protein, 9 aa, Homo Sapiens
ARISSSSFS

SEQ ID NO: 1399230 - protein, 9 aa, Homo Sapiens
APSGAWLGP

SEQ ID NO: 1399231 - protein, 9 aa, Homo Sapiens
IEGLIFSGH

SEQ ID NO: 1399232 - protein, 9 aa, Homo Sapiens
MKKNVPDQF

SEQ ID NO: 1399233 - protein, 9 aa, Homo Sapiens
PETGSSSAY

SEQ ID NO: 1399234 - protein, 9 aa, Homo Sapiens
MARDTQNQD

SEQ ID NO: 1399235 - protein, 9 aa, Homo Sapiens
NSVSLASVT

SEQ ID NO: 1399236 - protein, 9 aa, Homo Sapiens
PSIRGVMIV

SEQ ID NO: 1399237 - protein, 9 aa, Homo Sapiens
AELMVIDIN

SEQ ID NO: 1399238 - protein, 9 aa, Homo Sapiens
VWTISINSA

SEQ ID NO: 1399239 - protein, 9 aa, Homo Sapiens
KPCKCEECV

SEQ ID NO: 1399240 - protein, 9 aa, Homo Sapiens
DKDLMKQIL

SEQ ID NO: 1399241 - protein, 9 aa, Homo Sapiens
ILLKGETPN

SEQ ID NO: 1399242 - protein, 9 aa, Homo Sapiens
STAVVIMCL

SEQ ID NO: 1399243 - protein, 9 aa, Homo Sapiens
NKTGRFVFE

SEQ ID NO: 1399244 - protein, 9 aa, Homo Sapiens
EAESLGYVD

SEQ ID NO: 1399245 - protein, 9 aa, Homo Sapiens
TGRNRLRCG

SEQ ID NO: 1399246 - protein, 9 aa, Homo Sapiens
PLPSIRGVM

SEQ ID NO: 1399247 - protein, 9 aa, Homo Sapiens
LAVRHGAVT

SEQ ID NO: 1399248 - protein, 9 aa, Homo Sapiens
KVNESWKKS

SEQ ID NO: 1399249 - protein, 9 aa, Homo Sapiens
PPEARPWNL

SEQ ID NO: 1399250 - protein, 9 aa, Homo Sapiens
YTSGPGARI

SEQ ID NO: 1399251 - protein, 9 aa, Homo Sapiens
NKQSRTRTD

SEQ ID NO: 1399252 - protein, 9 aa, Homo Sapiens
LPSIRGVMI

SEQ ID NO: 1399253 - protein, 9 aa, Homo Sapiens
PWNLTWIDS

SEQ ID NO: 1399254 - protein, 9 aa, Homo Sapiens
VLSTNRIKE

SEQ ID NO: 1399255 - protein, 9 aa, Homo Sapiens
KEYILSYVP

SEQ ID NO: 1399256 - protein, 9 aa, Homo Sapiens
ELHAQAPHF

SEQ ID NO: 1399257 - protein, 9 aa, Homo Sapiens
PNKMSAFQN

SEQ ID NO: 1399258 - protein, 9 aa, Homo Sapiens
SLKYENYEM

SEQ ID NO: 1399259 - protein, 9 aa, Homo Sapiens
KAPAQAPPT

SEQ ID NO: 1399260 - protein, 9 aa, Homo Sapiens
GGIQGVPGK

SEQ ID NO: 1399261 - protein, 9 aa, Homo Sapiens
VPMKSSTQE

SEQ ID NO: 1399262 - protein, 9 aa, Homo Sapiens
SAFQNHCPH

SEQ ID NO: 1399263 - protein, 9 aa, Homo Sapiens
AVVIMCLLA

SEQ ID NO: 1399264 - protein, 9 aa, Homo Sapiens
TGYNERNKV

SEQ ID NO: 1399265 - protein, 9 aa, Homo Sapiens
NPTVVYLTK

SEQ ID NO: 1399266 - protein, 9 aa, Homo Sapiens
SGHHLHRAR

SEQ ID NO: 1399267 - protein, 9 aa, Homo Sapiens
KNMPSNTEL

SEQ ID NO: 1399268 - protein, 9 aa, Homo Sapiens
PHGLFVHGW

SEQ ID NO: 1399269 - protein, 9 aa, Homo Sapiens
ETGSSSAYA

SEQ ID NO: 1399270 - protein, 9 aa, Homo Sapiens
VPDQFNSHI

SEQ ID NO: 1399271 - protein, 9 aa, Homo Sapiens
FLPHEIPLL

SEQ ID NO: 1399272 - protein, 9 aa, Homo Sapiens
MTATPPKKM

SEQ ID NO: 1399273 - protein, 9 aa, Homo Sapiens
VAQLKPKVN

SEQ ID NO: 1399274 - protein, 9 aa, Homo Sapiens
KKSEEASPQ

SEQ ID NO: 1399275 - protein, 9 aa, Homo Sapiens
HPELVKLES

SEQ ID NO: 1399276 - protein, 9 aa, Homo Sapiens
VHCMHLHEK

SEQ ID NO: 1399277 - protein, 9 aa, Homo Sapiens
QLKPKVNSK

SEQ ID NO: 1399278 - protein, 9 aa, Homo Sapiens
CVKAFKHFS

SEQ ID NO: 1399279 - protein, 9 aa, Homo Sapiens
FKNMPSNTE

SEQ ID NO: 1399280 - protein, 9 aa, Homo Sapiens
ECLDDRNTF

SEQ ID NO: 1399281 - protein, 9 aa, Homo Sapiens
VECLDDRNT

SEQ ID NO: 1399282 - protein, 9 aa, Homo Sapiens
THSLTQRRS

SEQ ID NO: 1399283 - protein, 9 aa, Homo Sapiens
NLYGHLSER

SEQ ID NO: 1399284 - protein, 9 aa, Homo Sapiens
IAGPLRMLG

SEQ ID NO: 1399285 - protein, 9 aa, Homo Sapiens
DTNTKGNKQ

SEQ ID NO: 1399286 - protein, 9 aa, Homo Sapiens
GIQGVPGKP

SEQ ID NO: 1399287 - protein, 9 aa, Homo Sapiens
EMTLKSDTN

SEQ ID NO: 1399288 - protein, 9 aa, Homo Sapiens
KTGRFVFEE

SEQ ID NO: 1399289 - protein, 9 aa, Homo Sapiens
GARISSSSF

SEQ ID NO: 1399290 - protein, 9 aa, Homo Sapiens
VQEVAMTDL

SEQ ID NO: 1399291 - protein, 9 aa, Homo Sapiens
NISKAHTVG

SEQ ID NO: 1399292 - protein, 9 aa, Homo Sapiens
YEMTLKSDT

SEQ ID NO: 1399293 - protein, 9 aa, Homo Sapiens
RIMKKNVPD

SEQ ID NO: 1399294 - protein, 9 aa, Homo Sapiens
GNEIDVQTA

SEQ ID NO: 1399295 - protein, 9 aa, Homo Sapiens
LGRGIEGLI

SEQ ID NO: 1399296 - protein, 9 aa, Homo Sapiens
TSGIISSPS

SEQ ID NO: 1399297 - protein, 9 aa, Homo Sapiens
AMESMMHEE

SEQ ID NO: 1399298 - protein, 9 aa, Homo Sapiens
LVPETGSSS

SEQ ID NO: 1399299 - protein, 9 aa, Homo Sapiens
KNVPDQFNS

SEQ ID NO: 1399300 - protein, 9 aa, Homo Sapiens
RVWNMTATP

SEQ ID NO: 1399301 - protein, 9 aa, Homo Sapiens
HRELHAQAP

SEQ ID NO: 1399302 - protein, 9 aa, Homo Sapiens
LYFRNQKGH

SEQ ID NO: 1399303 - protein, 9 aa, Homo Sapiens
DHPELVKLE

SEQ ID NO: 1399304 - protein, 9 aa, Homo Sapiens
TSGPGARIS

SEQ ID NO: 1399305 - protein, 9 aa, Homo Sapiens
RGIEGLIFS

SEQ ID NO: 1399306 - protein, 9 aa, Homo Sapiens
SSIVKSNRR

SEQ ID NO: 1399307 - protein, 9 aa, Homo Sapiens
GAWLGPLPH

SEQ ID NO: 1399308 - protein, 9 aa, Homo Sapiens
QTAFFHGQM

SEQ ID NO: 1399309 - protein, 9 aa, Homo Sapiens
SGTSSKLYV

SEQ ID NO: 1399310 - protein, 9 aa, Homo Sapiens
GPGARISSS

SEQ ID NO: 1399311 - protein, 9 aa, Homo Sapiens
LSERFGRKF

SEQ ID NO: 1399312 - protein, 9 aa, Homo Sapiens
RLGDGLDPN

SEQ ID NO: 1399313 - protein, 9 aa, Homo Sapiens
ACGGTMRGT

SEQ ID NO: 1399314 - protein, 9 aa, Homo Sapiens
GNLRVECLD

SEQ ID NO: 1399315 - protein, 9 aa, Homo Sapiens
GSSSAYASS

SEQ ID NO: 1399316 - protein, 9 aa, Homo Sapiens
KSNRRQNPA

SEQ ID NO: 1399317 - protein, 9 aa, Homo Sapiens
PEARPWNLT

SEQ ID NO: 1399318 - protein, 9 aa, Homo Sapiens
FLGAGLFLY

SEQ ID NO: 1399319 - protein, 9 aa, Homo Sapiens
GVENAQPGA

SEQ ID NO: 1399320 - protein, 9 aa, Homo Sapiens
AHTVGRSGE

SEQ ID NO: 1399321 - protein, 9 aa, Homo Sapiens
DVAIIAGPL

SEQ ID NO: 1399322 - protein, 9 aa, Homo Sapiens
ETGYNERNK

SEQ ID NO: 1399323 - protein, 9 aa, Homo Sapiens
DVFKNMPSN

SEQ ID NO: 1399324 - protein, 9 aa, Homo Sapiens
TNRIKEVDA

SEQ ID NO: 1399325 - protein, 9 aa, Homo Sapiens
GAVTDTIDI

SEQ ID NO: 1399326 - protein, 9 aa, Homo Sapiens
MQFHFLSWY

SEQ ID NO: 1399327 - protein, 9 aa, Homo Sapiens
LRVECLDDR

SEQ ID NO: 1399328 - protein, 9 aa, Homo Sapiens
AVPAKRVRL

SEQ ID NO: 1399329 - protein, 9 aa, Homo Sapiens
KPGQEATVL

SEQ ID NO: 1399330 - protein, 9 aa, Homo Sapiens
YLKHQFNPT

SEQ ID NO: 1399331 - protein, 9 aa, Homo Sapiens
ETPNEELLE

SEQ ID NO: 1399332 - protein, 9 aa, Homo Sapiens
KGNKQSRTR

SEQ ID NO: 1399333 - protein, 9 aa, Homo Sapiens
AIIAGPLRM

SEQ ID NO: 1399334 - protein, 9 aa, Homo Sapiens
HTSTVHCMH

SEQ ID NO: 1399335 - protein, 9 aa, Homo Sapiens
EAMESMMHE

SEQ ID NO: 1399336 - protein, 9 aa, Homo Sapiens
DNFTALFGA

SEQ ID NO: 1399337 - protein, 9 aa, Homo Sapiens
QLHRELHAQ

SEQ ID NO: 1399338 - protein, 9 aa, Homo Sapiens
HRARCTDVD

SEQ ID NO: 1399339 - protein, 9 aa, Homo Sapiens
EYILSYVPA

SEQ ID NO: 1399340 - protein, 9 aa, Homo Sapiens
NDKAPAQAP

SEQ ID NO: 1399341 - protein, 9 aa, Homo Sapiens
LFLYFRNQK

SEQ ID NO: 1399342 - protein, 9 aa, Homo Sapiens
VQTAFFHGQ

SEQ ID NO: 1399343 - protein, 9 aa, Homo Sapiens
MGNEIDVQT

SEQ ID NO: 1399344 - protein, 9 aa, Homo Sapiens
KYENYEMTL

SEQ ID NO: 1399345 - protein, 9 aa, Homo Sapiens
VTSFLPHEI

SEQ ID NO: 1399346 - protein, 9 aa, Homo Sapiens
RGVMIVLGA

SEQ ID NO: 1399347 - protein, 9 aa, Homo Sapiens
IRGVMIVLG

SEQ ID NO: 1399348 - protein, 9 aa, Homo Sapiens
GVMIVLGAG

SEQ ID NO: 1399349 - protein, 9 aa, Homo Sapiens
KLYVKDFEQ

SEQ ID NO: 1399350 - protein, 9 aa, Homo Sapiens
VMVAPSGAW

SEQ ID NO: 1399351 - protein, 9 aa, Homo Sapiens
VGRSGETSH

SEQ ID NO: 1399352 - protein, 9 aa, Homo Sapiens
HLIVQEVAM

SEQ ID NO: 1399353 - protein, 9 aa, Homo Sapiens
QAEALLDEL

SEQ ID NO: 1399354 - protein, 9 aa, Homo Sapiens
RHGAVTDTI

SEQ ID NO: 1399355 - protein, 9 aa, Homo Sapiens
PGARISSSS

SEQ ID NO: 1399356 - protein, 9 aa, Homo Sapiens
VAPSGAWLG

SEQ ID NO: 1399357 - protein, 9 aa, Homo Sapiens
FVHGWFGHF

SEQ ID NO: 1399358 - protein, 9 aa, Homo Sapiens
AGPLRMLGD

SEQ ID NO: 1399359 - protein, 9 aa, Homo Sapiens
QAPHFQVSL

SEQ ID NO: 1399360 - protein, 9 aa, Homo Sapiens
NMTATPPKK

SEQ ID NO: 1399361 - protein, 9 aa, Homo Sapiens
GPLRMLGDQ

SEQ ID NO: 1399362 - protein, 9 aa, Homo Sapiens
AWLGPLPHL

SEQ ID NO: 1399363 - protein, 9 aa, Homo Sapiens
CLMARDTQN

SEQ ID NO: 1399364 - protein, 9 aa, Homo Sapiens
LKPKVNSKG

SEQ ID NO: 1399365 - protein, 9 aa, Homo Sapiens
DVQTAFFHG

SEQ ID NO: 1399366 - protein, 9 aa, Homo Sapiens
IPLLEGMET

SEQ ID NO: 1399367 - protein, 9 aa, Homo Sapiens
EALLDELEK

SEQ ID NO: 1399368 - protein, 9 aa, Homo Sapiens
HGLFVHGWF

SEQ ID NO: 1399369 - protein, 9 aa, Homo Sapiens
KKNVPDQFN

SEQ ID NO: 1399370 - protein, 9 aa, Homo Sapiens
TGRFVFEEI

SEQ ID NO: 1399371 - protein, 9 aa, Homo Sapiens
IMCLLAIGS

SEQ ID NO: 1399372 - protein, 9 aa, Homo Sapiens
SYVPALKPF

SEQ ID NO: 1399373 - protein, 9 aa, Homo Sapiens
GNLYGHLSE

SEQ ID NO: 1399374 - protein, 9 aa, Homo Sapiens
ALGEFLYKS

SEQ ID NO: 1399375 - protein, 9 aa, Homo Sapiens
RVECLDDRN

SEQ ID NO: 1399376 - protein, 9 aa, Homo Sapiens
KDLMKQILC

SEQ ID NO: 1399377 - protein, 9 aa, Homo Sapiens
LVKLESCKL

SEQ ID NO: 1399378 - protein, 9 aa, Homo Sapiens
AKRVRLPPG

SEQ ID NO: 1399379 - protein, 9 aa, Homo Sapiens
IMKKNVPDQ

SEQ ID NO: 1399380 - protein, 9 aa, Homo Sapiens
SGAWLGPLP

SEQ ID NO: 1399381 - protein, 9 aa, Homo Sapiens
SEEASPQVL

SEQ ID NO: 1399382 - protein, 9 aa, Homo Sapiens
GTSGIISSP

SEQ ID NO: 1399383 - protein, 9 aa, Homo Sapiens
TKEHRWGSG

SEQ ID NO: 1399384 - protein, 9 aa, Homo Sapiens
MKSSTQEIG

SEQ ID NO: 1399385 - protein, 9 aa, Homo Sapiens
LFVHGWFGH

SEQ ID NO: 1399386 - protein, 9 aa, Homo Sapiens
EKPGQEATV

SEQ ID NO: 1399387 - protein, 9 aa, Homo Sapiens
EHRWGSGLL

SEQ ID NO: 1399388 - protein, 9 aa, Homo Sapiens
SVQGRRKRF

SEQ ID NO: 1399389 - protein, 9 aa, Homo Sapiens
NTELIVRVE

SEQ ID NO: 1399390 - protein, 9 aa, Homo Sapiens
VPETGSSSA

SEQ ID NO: 1399391 - protein, 9 aa, Homo Sapiens
GRFVFEEIP

SEQ ID NO: 1399392 - protein, 9 aa, Homo Sapiens
VLLSHQRTH

SEQ ID NO: 1399393 - protein, 9 aa, Homo Sapiens
QTNETRTVM

SEQ ID NO: 1399394 - protein, 9 aa, Homo Sapiens
GHLSERFGR

SEQ ID NO: 1399395 - protein, 9 aa, Homo Sapiens
SVFVALGEF

SEQ ID NO: 1399396 - protein, 9 aa, Homo Sapiens
ELEKKPTSK

SEQ ID NO: 1399397 - protein, 9 aa, Homo Sapiens
DPCLMARDT

SEQ ID NO: 1399398 - protein, 9 aa, Homo Sapiens
EELVLSTNR

SEQ ID NO: 1399399 - protein, 9 aa, Homo Sapiens
YILSYVPAL

SEQ ID NO: 1399400 - protein, 9 aa, Homo Sapiens
QPGKKSEEA

SEQ ID NO: 1399401 - protein, 9 aa, Homo Sapiens
GQVPMKSST

SEQ ID NO: 1399402 - protein, 9 aa, Homo Sapiens
NYEMTLKSD

SEQ ID NO: 1399403 - protein, 9 aa, Homo Sapiens
QAPPTVFRW

SEQ ID NO: 1399404 - protein, 9 aa, Homo Sapiens
PMKSSTQEI

SEQ ID NO: 1399405 - protein, 9 aa, Homo Sapiens
SVWTISINS

SEQ ID NO: 1399406 - protein, 9 aa, Homo Sapiens
SAYASSFSL

SEQ ID NO: 1399407 - protein, 9 aa, Homo Sapiens
HPHGLFVHG

SEQ ID NO: 1399408 - protein, 9 aa, Homo Sapiens
LGLAVRHGA

SEQ ID NO: 1399409 - protein, 9 aa, Homo Sapiens
ECVKAFKHF

SEQ ID NO: 1399410 - protein, 9 aa, Homo Sapiens
RLPPEARPW

SEQ ID NO: 1399411 - protein, 9 aa, Homo Sapiens
MCLLAIGSS

SEQ ID NO: 1399412 - protein, 9 aa, Homo Sapiens
FQAELMVID

SEQ ID NO: 1399413 - protein, 9 aa, Homo Sapiens
PGQVPMKSS

SEQ ID NO: 1399414 - protein, 9 aa, Homo Sapiens
TSSKLYVKD

SEQ ID NO: 1399415 - protein, 9 aa, Homo Sapiens
AAVPAKRVR

SEQ ID NO: 1399416 - protein, 9 aa, Homo Sapiens
EKGDGGIQG

SEQ ID NO: 1399417 - protein, 9 aa, Homo Sapiens
KQICPGVEN

SEQ ID NO: 1399418 - protein, 9 aa, Homo Sapiens
TVGRSGETS

SEQ ID NO: 1399419 - protein, 9 aa, Homo Sapiens
LEIFQAELM

SEQ ID NO: 1399420 - protein, 9 aa, Homo Sapiens
GHHLHRARC

SEQ ID NO: 1399421 - protein, 9 aa, Homo Sapiens
LSTNRIKEV

SEQ ID NO: 1399422 - protein, 9 aa, Homo Sapiens
LIVQEVAMT

SEQ ID NO: 1399423 - protein, 9 aa, Homo Sapiens
LKGETPNEE

SEQ ID NO: 1399424 - protein, 9 aa, Homo Sapiens
SSAYASSFS

SEQ ID NO: 1399425 - protein, 9 aa, Homo Sapiens
KQSRTRTDS

SEQ ID NO: 1399426 - protein, 9 aa, Homo Sapiens
RSYTSGPGA

SEQ ID NO: 1399427 - protein, 9 aa, Homo Sapiens
KLESCKLIE

SEQ ID NO: 1399428 - protein, 9 aa, Homo Sapiens
MRGTSGIIS

SEQ ID NO: 1399429 - protein, 9 aa, Homo Sapiens
YGHTSTVHC

SEQ ID NO: 1399430 - protein, 9 aa, Homo Sapiens
DLGLAVRHG

SEQ ID NO: 1399431 - protein, 9 aa, Homo Sapiens
APAQAPPTV

SEQ ID NO: 1399432 - protein, 9 aa, Homo Sapiens
NVHLIVQEV

SEQ ID NO: 1399433 - protein, 9 aa, Homo Sapiens
NCDGYASSV

SEQ ID NO: 1399434 - protein, 9 aa, Homo Sapiens
PLRMLGDQF

SEQ ID NO: 1399435 - protein, 9 aa, Homo Sapiens
LFLGAGLFL

SEQ ID NO: 1399436 - protein, 9 aa, Homo Sapiens
VIMCLLAIG

SEQ ID NO: 1399437 - protein, 9 aa, Homo Sapiens
VALGEFLYK

SEQ ID NO: 1399438 - protein, 9 aa, Homo Sapiens
CHPHGLFVH

SEQ ID NO: 1399439 - protein, 9 aa, Homo Sapiens
KPKVNSKGL

SEQ ID NO: 1399440 - protein, 9 aa, Homo Sapiens
ASNTSSIVK

SEQ ID NO: 1399441 - protein, 9 aa, Homo Sapiens
HLSERFGRK

SEQ ID NO: 1399442 - protein, 9 aa, Homo Sapiens
AYYLKHQFN

SEQ ID NO: 1399443 - protein, 9 aa, Homo Sapiens
IIAGPLRML

SEQ ID NO: 1399444 - protein, 9 aa, Homo Sapiens
LEKKPTSKQ

SEQ ID NO: 1399445 - protein, 9 aa, Homo Sapiens
STNRIKEVD

SEQ ID NO: 1399446 - protein, 9 aa, Homo Sapiens
LHAQAPHFQ

SEQ ID NO: 1399447 - protein, 9 aa, Homo Sapiens
PPGQVPMKS

SEQ ID NO: 1399448 - protein, 9 aa, Homo Sapiens
AESLGYVDV

SEQ ID NO: 1399449 - protein, 9 aa, Homo Sapiens
PCLMARDTQ

SEQ ID NO: 1399450 - protein, 9 aa, Homo Sapiens
CDGYASSVW

SEQ ID NO: 1399451 - protein, 9 aa, Homo Sapiens
YYLKHQFNP

SEQ ID NO: 1399452 - protein, 9 aa, Homo Sapiens
TPVFTSGLT

SEQ ID NO: 1399453 - protein, 9 aa, Homo Sapiens
ANDVDKDLM

SEQ ID NO: 1399454 - protein, 9 aa, Homo Sapiens
GSGLLSRNH

SEQ ID NO: 1399455 - protein, 9 aa, Homo Sapiens
IVQEVAMTD

SEQ ID NO: 1399456 - protein, 9 aa, Homo Sapiens
TRTVMQFHF

SEQ ID NO: 1399457 - protein, 9 aa, Homo Sapiens
ILSYVPALK

SEQ ID NO: 1399458 - protein, 9 aa, Homo Sapiens
GIEGLIFSG

SEQ ID NO: 1399459 - protein, 9 aa, Homo Sapiens
WLGPLPHLQ

SEQ ID NO: 1399460 - protein, 9 aa, Homo Sapiens
TFEEAESLG

SEQ ID NO: 1399461 - protein, 9 aa, Homo Sapiens
KILLKGETP

SEQ ID NO: 1399462 - protein, 9 aa, Homo Sapiens
EYREAMESM

SEQ ID NO: 1399463 - protein, 9 aa, Homo Sapiens
KAHTVGRSG

SEQ ID NO: 1399464 - protein, 9 aa, Homo Sapiens
LKHQFNPTV

SEQ ID NO: 1399465 - protein, 9 aa, Homo Sapiens
LLKGETPNE

SEQ ID NO: 1399466 - protein, 9 aa, Homo Sapiens
SNTSSIVKS

SEQ ID NO: 1399467 - protein, 9 aa, Homo Sapiens
VLKQICPGV

SEQ ID NO: 1399468 - protein, 9 aa, Homo Sapiens
NKVNESWKK

SEQ ID NO: 1399469 - protein, 9 aa, Homo Sapiens
NTKGNKQSR

SEQ ID NO: 1399470 - protein, 9 aa, Homo Sapiens
GEKGDGGIQ

SEQ ID NO: 1399471 - protein, 9 aa, Homo Sapiens
KEYREAMES

SEQ ID NO: 1399472 - protein, 9 aa, Homo Sapiens
LPHEIPLLE

SEQ ID NO: 1399473 - protein, 9 aa, Homo Sapiens
KHQFNPTVV

SEQ ID NO: 1399474 - protein, 9 aa, Homo Sapiens
HGAVTDTID

SEQ ID NO: 1399475 - protein, 9 aa, Homo Sapiens
GHPPGQVPM

SEQ ID NO: 1399476 - protein, 9 aa, Homo Sapiens
LDELEKKPT

SEQ ID NO: 1399477 - protein, 9 aa, Homo Sapiens
GLFVHGWFG

SEQ ID NO: 1399478 - protein, 9 aa, Homo Sapiens
ARCTDVDEC

SEQ ID NO: 1399479 - protein, 9 aa, Homo Sapiens
LDPNSVSLA

SEQ ID NO: 1399480 - protein, 9 aa, Homo Sapiens
APPTVFRWT

SEQ ID NO: 1399481 - protein, 9 aa, Homo Sapiens
GETPNEELL

SEQ ID NO: 1399482 - protein, 9 aa, Homo Sapiens
VHGWFGHFA

SEQ ID NO: 1399483 - protein, 9 aa, Homo Sapiens
KLEELVLST

SEQ ID NO: 1399484 - protein, 9 aa, Homo Sapiens
REAMESMMH

SEQ ID NO: 1399485 - protein, 9 aa, Homo Sapiens
QEATVLPKD

SEQ ID NO: 1399486 - protein, 9 aa, Homo Sapiens
QFNPTVVYL

SEQ ID NO: 1399487 - protein, 9 aa, Homo Sapiens
NTSSIVKSN

SEQ ID NO: 1399488 - protein, 9 aa, Homo Sapiens
SERFGRKFV

SEQ ID NO: 1399489 - protein, 9 aa, Homo Sapiens
ETRTVMQFH

SEQ ID NO: 1399490 - protein, 9 aa, Homo Sapiens
QSRTRTDSY

SEQ ID NO: 1399491 - protein, 9 aa, Homo Sapiens
NEIDVQTAF

SEQ ID NO: 1399492 - protein, 9 aa, Homo Sapiens
ATVLPKDGA

SEQ ID NO: 1399493 - protein, 9 aa, Homo Sapiens
VKEYILSYV

SEQ ID NO: 1399494 - protein, 9 aa, Homo Sapiens
ELVLSTNRI

SEQ ID NO: 1399495 - protein, 9 aa, Homo Sapiens
IDVQTAFFH

SEQ ID NO: 1399496 - protein, 9 aa, Homo Sapiens
FQNHCPHLD

SEQ ID NO: 1399497 - protein, 9 aa, Homo Sapiens
VPALKPFGA

SEQ ID NO: 1399498 - protein, 9 aa, Homo Sapiens
IQGVPGKPG

SEQ ID NO: 1399499 - protein, 9 aa, Homo Sapiens
QEVAMTDLC

SEQ ID NO: 1399500 - protein, 9 aa, Homo Sapiens
NSKGLPTGL

SEQ ID NO: 1399501 - protein, 9 aa, Homo Sapiens
TNETRTVMQ

SEQ ID NO: 1399502 - protein, 9 aa, Homo Sapiens
GTMRGTSGI

SEQ ID NO: 1399503 - protein, 9 aa, Homo Sapiens
SVLLSHQRT

SEQ ID NO: 1399504 - protein, 9 aa, Homo Sapiens
NKMSAFQNH

SEQ ID NO: 1399505 - protein, 9 aa, Homo Sapiens
MANDVDKDL

SEQ ID NO: 1399506 - protein, 9 aa, Homo Sapiens
LLDELEKKP

SEQ ID NO: 1399507 - protein, 9 aa, Homo Sapiens
NMPSNTELI

SEQ ID NO: 1399508 - protein, 9 aa, Homo Sapiens
NVPDQFNSH

SEQ ID NO: 1399509 - protein, 9 aa, Homo Sapiens
PDPCLMARD

SEQ ID NO: 1399510 - protein, 9 aa, Homo Sapiens
ARPWNLTWI

SEQ ID NO: 1399511 - protein, 9 aa, Homo Sapiens
VHLIVQEVA

SEQ ID NO: 1399512 - protein, 9 aa, Homo Sapiens
FLYFRNQKG

SEQ ID NO: 1399513 - protein, 9 aa, Homo Sapiens
LHRARCTDV

SEQ ID NO: 1399514 - protein, 9 aa, Homo Sapiens
QICPGVENA

SEQ ID NO: 1399515 - protein, 9 aa, Homo Sapiens
HRWGSGLLS

SEQ ID NO: 1399516 - protein, 9 aa, Homo Sapiens
DELEKKPTS

SEQ ID NO: 1399517 - protein, 9 aa, Homo Sapiens
SGPGARISS

SEQ ID NO: 1399518 - protein, 9 aa, Homo Sapiens
DTQNQDAPC

SEQ ID NO: 1399519 - protein, 9 aa, Homo Sapiens
RSVQGRRKR

SEQ ID NO: 1399520 - protein, 9 aa, Homo Sapiens
LGAGLFLYF

SEQ ID NO: 1399521 - protein, 9 aa, Homo Sapiens
ISKAHTVGR

SEQ ID NO: 1399522 - protein, 9 aa, Homo Sapiens
LEELVLSTN

SEQ ID NO: 1399523 - protein, 9 aa, Homo Sapiens
ARDTQNQDA

SEQ ID NO: 1399524 - protein, 9 aa, Homo Sapiens
LVLSTNRIK

SEQ ID NO: 1399525 - protein, 9 aa, Homo Sapiens
MLPLSTPVF

SEQ ID NO: 1399526 - protein, 9 aa, Homo Sapiens
HSLTQRRSV

SEQ ID NO: 1399527 - protein, 9 aa, Homo Sapiens
SKLYVKDFE

SEQ ID NO: 1399528 - protein, 9 aa, Homo Sapiens
ASSVWTISI

SEQ ID NO: 1399529 - protein, 9 aa, Homo Sapiens
FNPTVVYLT

SEQ ID NO: 1399530 - protein, 9 aa, Homo Sapiens
CPGVENAQP

SEQ ID NO: 1399531 - protein, 9 aa, Homo Sapiens
PGKKSEEAS

SEQ ID NO: 1399532 - protein, 9 aa, Homo Sapiens
QAELMVIDI

SEQ ID NO: 1399533 - protein, 9 aa, Homo Sapiens
ESLGYVDVG

SEQ ID NO: 1399534 - protein, 9 aa, Homo Sapiens
RFVFEEIPG

SEQ ID NO: 1399535 - protein, 9 aa, Homo Sapiens
VEGNLRVEC

SEQ ID NO: 1399536 - protein, 9 aa, Homo Sapiens
QGVPGKPGR

SEQ ID NO: 1399537 - protein, 9 aa, Homo Sapiens
KSGTSSKLY

SEQ ID NO: 1399538 - protein, 9 aa, Homo Sapiens
TSTVHCMHL

SEQ ID NO: 1399539 - protein, 9 aa, Homo Sapiens
MPSNTELIV

SEQ ID NO: 1399540 - protein, 9 aa, Homo Sapiens
LPLSTPVFT

SEQ ID NO: 1399541 - protein, 9 aa, Homo Sapiens
VRHGAVTDT

SEQ ID NO: 1399542 - protein, 9 aa, Homo Sapiens
EIFQAELMV

SEQ ID NO: 1399543 - protein, 9 aa, Homo Sapiens
LPPEARPWN

SEQ ID NO: 1399544 - protein, 9 aa, Homo Sapiens
HPPGQVPMK

SEQ ID NO: 1399545 - protein, 9 aa, Homo Sapiens
PELVKLESC

SEQ ID NO: 1399546 - protein, 9 aa, Homo Sapiens
SNKTGRFVF

SEQ ID NO: 1399547 - protein, 9 aa, Homo Sapiens
RGTSGIISS

SEQ ID NO: 1399548 - protein, 9 aa, Homo Sapiens
YVKDFEQTL

SEQ ID NO: 1399549 - protein, 9 aa, Homo Sapiens
VAIIAGPLR

SEQ ID NO: 1399550 - protein, 9 aa, Homo Sapiens
FEEIPGEFT

SEQ ID NO: 1399551 - protein, 9 aa, Homo Sapiens
MDNFTALFG

SEQ ID NO: 1399552 - protein, 9 aa, Homo Sapiens
PHEIPLLEG

SEQ ID NO: 1399553 - protein, 9 aa, Homo Sapiens
GANVHLIVQ

SEQ ID NO: 1399554 - protein, 9 aa, Homo Sapiens
WNLTWIDSP

SEQ ID NO: 1399555 - protein, 9 aa, Homo Sapiens
RVRLPPGKA

SEQ ID NO: 1399556 - protein, 9 aa, Homo Sapiens
NERNKVNES

SEQ ID NO: 1399557 - protein, 9 aa, Homo Sapiens
LGEFLYKSK

SEQ ID NO: 1399558 - protein, 9 aa, Homo Sapiens
GMGNEIDVQ

SEQ ID NO: 1399559 - protein, 9 aa, Homo Sapiens
VKLESCKLI

SEQ ID NO: 1399560 - protein, 9 aa, Homo Sapiens
VFVALGEFL

SEQ ID NO: 1399561 - protein, 9 aa, Homo Sapiens
GNKQSRTRT

SEQ ID NO: 1399562 - protein, 9 aa, Homo Sapiens
WQSVLLSHQ

SEQ ID NO: 1399563 - protein, 9 aa, Homo Sapiens
TGSSSAYAS

SEQ ID NO: 1399564 - protein, 9 aa, Homo Sapiens
MVAPSGAWL

SEQ ID NO: 1399565 - protein, 9 aa, Homo Sapiens
PSNTELIVR

SEQ ID NO: 1399566 - protein, 9 aa, Homo Sapiens
AEALLDELE

SEQ ID NO: 1399567 - protein, 9 aa, Homo Sapiens
DPNSVSLAS

SEQ ID NO: 1399568 - protein, 9 aa, Homo Sapiens
SLTQRRSVQ

SEQ ID NO: 1399569 - protein, 9 aa, Homo Sapiens
GKKSEEASP

SEQ ID NO: 1399570 - protein, 9 aa, Homo Sapiens
HEIPLLEGM

SEQ ID NO: 1399571 - protein, 9 aa, Homo Sapiens
GDGLDPNSV

SEQ ID NO: 1399572 - protein, 9 aa, Homo Sapiens
GLLSRNHSL

SEQ ID NO: 1399573 - protein, 9 aa, Homo Sapiens
RTGRNRLRC

SEQ ID NO: 1399574 - protein, 9 aa, Homo Sapiens
VPAKRVRLP

SEQ ID NO: 1399575 - protein, 9 aa, Homo Sapiens
GTFEEAESL

SEQ ID NO: 1399576 - protein, 9 aa, Homo Sapiens
PGVENAQPG

SEQ ID NO: 1399577 - protein, 9 aa, Homo Sapiens
LYVKDFEQT

SEQ ID NO: 1399578 - protein, 9 aa, Homo Sapiens
RRSVQGRRK

SEQ ID NO: 1399579 - protein, 9 aa, Homo Sapiens
PSGHHLHRA

SEQ ID NO: 1399580 - protein, 9 aa, Homo Sapiens
AQLKPKVNS

SEQ ID NO: 1399581 - protein, 9 aa, Homo Sapiens
VRLPPGKAA

SEQ ID NO: 1399582 - protein, 9 aa, Homo Sapiens
SIVKSNRRQ

SEQ ID NO: 1399583 - protein, 9 aa, Homo Sapiens
ISWRTGRNR

SEQ ID NO: 1399584 - protein, 9 aa, Homo Sapiens
DVDKDLMKQ

SEQ ID NO: 1399585 - protein, 9 aa, Homo Sapiens
WRTGRNRLR

SEQ ID NO: 1399586 - protein, 9 aa, Homo Sapiens
PPKKMGSQL

SEQ ID NO: 1399587 - protein, 9 aa, Homo Sapiens
VLSVFVALG

SEQ ID NO: 1399588 - protein, 9 aa, Homo Sapiens
KGETPNEEL

SEQ ID NO: 1399589 - protein, 9 aa, Homo Sapiens
LSVFVALGE

SEQ ID NO: 1399590 - protein, 9 aa, Homo Sapiens
KVNSKGLPT

SEQ ID NO: 1399591 - protein, 9 aa, Homo Sapiens
ANVHLIVQE

SEQ ID NO: 1399592 - protein, 9 aa, Homo Sapiens
VWNMTATPP

SEQ ID NO: 1399593 - protein, 9 aa, Homo Sapiens
PNEELLEAV

SEQ ID NO: 1399594 - protein, 9 aa, Homo Sapiens
LVLSVFVAL

SEQ ID NO: 1399595 - protein, 9 aa, Homo Sapiens
SKAHTVGRS

SEQ ID NO: 1399596 - protein, 9 aa, Homo Sapiens
NRLRCGGTA

SEQ ID NO: 1399597 - protein, 9 aa, Homo Sapiens
TMRGTSGII

SEQ ID NO: 1399598 - protein, 9 aa, Homo Sapiens
QRRSVQGRR

SEQ ID NO: 1399599 - protein, 9 aa, Homo Sapiens
DGGIQGVPG

SEQ ID NO: 1399600 - protein, 9 aa, Homo Sapiens
CLDDRNTFR

SEQ ID NO: 1399601 - protein, 9 aa, Homo Sapiens
DGYASSVWT

SEQ ID NO: 1399602 - protein, 9 aa, Homo Sapiens
SWRTGRNRL

SEQ ID NO: 1399603 - protein, 9 aa, Homo Sapiens
CEECVKAFK

SEQ ID NO: 1399604 - protein, 9 aa, Homo Sapiens
GDGGIQGVP

SEQ ID NO: 1399605 - protein, 9 aa, Homo Sapiens
GRNRLRCGG

SEQ ID NO: 1399606 - protein, 9 aa, Homo Sapiens
VKAFKHFSA

SEQ ID NO: 1399607 - protein, 9 aa, Homo Sapiens
YENYEMTLK

SEQ ID NO: 1399608 - protein, 9 aa, Homo Sapiens
SGTFEEAES

SEQ ID NO: 1399609 - protein, 9 aa, Homo Sapiens
DKAPAQAPP

SEQ ID NO: 1399610 - protein, 9 aa, Homo Sapiens
HFNLGRGIE

SEQ ID NO: 1399611 - protein, 9 aa, Homo Sapiens
TVLPKDGAV

SEQ ID NO: 1399612 - protein, 9 aa, Homo Sapiens
EEAESLGYV

SEQ ID NO: 1399613 - protein, 9 aa, Homo Sapiens
KRVRLPPGK

SEQ ID NO: 1399614 - protein, 9 aa, Homo Sapiens
SSSAYASSF

SEQ ID NO: 1399615 - protein, 9 aa, Homo Sapiens
SYTSGPGAR

SEQ ID NO: 1399616 - protein, 9 aa, Homo Sapiens
PDQFNSHIQ

SEQ ID NO: 1399617 - protein, 9 aa, Homo Sapiens
MESMMHEEH

SEQ ID NO: 1399618 - protein, 9 aa, Homo Sapiens
RLPPGKAAA

SEQ ID NO: 1399619 - protein, 9 aa, Homo Sapiens
SMANDVDKD

SEQ ID NO: 1399620 - protein, 9 aa, Homo Sapiens
HYNISSIYF

SEQ ID NO: 1399621 - protein, 9 aa, Homo Sapiens
KAAQERAIV

SEQ ID NO: 1399622 - protein, 9 aa, Homo Sapiens
SAALEISLC

SEQ ID NO: 1399623 - protein, 9 aa, Homo Sapiens
SNPENTIFD

SEQ ID NO: 1399624 - protein, 9 aa, Homo Sapiens
CVYLEAGMV

SEQ ID NO: 1399625 - protein, 9 aa, Homo Sapiens
QDFANMTEL

SEQ ID NO: 1399626 - protein, 9 aa, Homo Sapiens
KNEVHETFS

SEQ ID NO: 1399627 - protein, 9 aa, Homo Sapiens
ELIVHVELS

SEQ ID NO: 1399628 - protein, 9 aa, Homo Sapiens
CSDDTRMVR

SEQ ID NO: 1399629 - protein, 9 aa, Homo Sapiens
DFANMTELV

SEQ ID NO: 1399630 - protein, 9 aa, Homo Sapiens
LGNGDILEY

SEQ ID NO: 1399631 - protein, 9 aa, Homo Sapiens
IPPLPEHQK

SEQ ID NO: 1399632 - protein, 9 aa, Homo Sapiens
FSWARTSPL

SEQ ID NO: 1399633 - protein, 9 aa, Homo Sapiens
KILCATYVI

SEQ ID NO: 1399634 - protein, 9 aa, Homo Sapiens
LCSDDTRMV

SEQ ID NO: 1399635 - protein, 9 aa, Homo Sapiens
LEAGMVTAS

SEQ ID NO: 1399636 - protein, 9 aa, Homo Sapiens
LAVDHYNIS

SEQ ID NO: 1399637 - protein, 9 aa, Homo Sapiens
MEAEIKAAQ

SEQ ID NO: 1399638 - protein, 9 aa, Homo Sapiens
QKMKKNEVH

SEQ ID NO: 1399639 - protein, 9 aa, Homo Sapiens
HFIFHILGT

SEQ ID NO: 1399640 - protein, 9 aa, Homo Sapiens
NKETDPVKI

SEQ ID NO: 1399641 - protein, 9 aa, Homo Sapiens
RIFAIDENL

SEQ ID NO: 1399642 - protein, 9 aa, Homo Sapiens
KRMTTKLIR

SEQ ID NO: 1399643 - protein, 9 aa, Homo Sapiens
RQFDNFKWV

SEQ ID NO: 1399644 - protein, 9 aa, Homo Sapiens
EVHETFSYP

SEQ ID NO: 1399645 - protein, 9 aa, Homo Sapiens
HAVSQQRQP

SEQ ID NO: 1399646 - protein, 9 aa, Homo Sapiens
TSNPENTIF

SEQ ID NO: 1399647 - protein, 9 aa, Homo Sapiens
MLGNGDILE

SEQ ID NO: 1399648 - protein, 9 aa, Homo Sapiens
NWRPILTII

SEQ ID NO: 1399649 - protein, 9 aa, Homo Sapiens
KIKRMTTKL

SEQ ID NO: 1399650 - protein, 9 aa, Homo Sapiens
CMGGMNWRP

SEQ ID NO: 1399651 - protein, 9 aa, Homo Sapiens
CETRCGQIL

SEQ ID NO: 1399652 - protein, 9 aa, Homo Sapiens
REQIAVWTN

SEQ ID NO: 1399653 - protein, 9 aa, Homo Sapiens
FDNFKWVFK

SEQ ID NO: 1399654 - protein, 9 aa, Homo Sapiens
IKRMTTKLI

SEQ ID NO: 1399655 - protein, 9 aa, Homo Sapiens
ECQILGHSD

SEQ ID NO: 1399656 - protein, 9 aa, Homo Sapiens
CNMERSRED

SEQ ID NO: 1399657 - protein, 9 aa, Homo Sapiens
QHLWTLHWM

SEQ ID NO: 1399658 - protein, 9 aa, Homo Sapiens
KWVFKVVEE

SEQ ID NO: 1399659 - protein, 9 aa, Homo Sapiens
DTRMVRRAA

SEQ ID NO: 1399660 - protein, 9 aa, Homo Sapiens
YNISSIYFL

SEQ ID NO: 1399661 - protein, 9 aa, Homo Sapiens
LPFTTPTPG

SEQ ID NO: 1399662 - protein, 9 aa, Homo Sapiens
TPGPAHGPL

SEQ ID NO: 1399663 - protein, 9 aa, Homo Sapiens
EISLCNMER

SEQ ID NO: 1399664 - protein, 9 aa, Homo Sapiens
WARTSPLSR

SEQ ID NO: 1399665 - protein, 9 aa, Homo Sapiens
EDKIKRMTT

SEQ ID NO: 1399666 - protein, 9 aa, Homo Sapiens
YIACRQKGV

SEQ ID NO: 1399667 - protein, 9 aa, Homo Sapiens
AKPAMLNLK

SEQ ID NO: 1399668 - protein, 9 aa, Homo Sapiens
GMNWRPILT

SEQ ID NO: 1399669 - protein, 9 aa, Homo Sapiens
ETDPVKIPP

SEQ ID NO: 1399670 - protein, 9 aa, Homo Sapiens
KEAFWQLSH

SEQ ID NO: 1399671 - protein, 9 aa, Homo Sapiens
VIVNIRDID

SEQ ID NO: 1399672 - protein, 9 aa, Homo Sapiens
DDTRMVRRA

SEQ ID NO: 1399673 - protein, 9 aa, Homo Sapiens
YLHNCETRC

SEQ ID NO: 1399674 - protein, 9 aa, Homo Sapiens
GPSHAPFLS

SEQ ID NO: 1399675 - protein, 9 aa, Homo Sapiens
CQILGHSDR

SEQ ID NO: 1399676 - protein, 9 aa, Homo Sapiens
TALPFTTPT

SEQ ID NO: 1399677 - protein, 9 aa, Homo Sapiens
KTELIVHVE

SEQ ID NO: 1399678 - protein, 9 aa, Homo Sapiens
ISSIYFLAV

SEQ ID NO: 1399679 - protein, 9 aa, Homo Sapiens
TSPLSRAAA

SEQ ID NO: 1399680 - protein, 9 aa, Homo Sapiens
HRIFAIDEN

SEQ ID NO: 1399681 - protein, 9 aa, Homo Sapiens
GPAASCTGV

SEQ ID NO: 1399682 - protein, 9 aa, Homo Sapiens
FHILGTPTE

SEQ ID NO: 1399683 - protein, 9 aa, Homo Sapiens
SSCMGGMNW

SEQ ID NO: 1399684 - protein, 9 aa, Homo Sapiens
SKTELIVHV

SEQ ID NO: 1399685 - protein, 9 aa, Homo Sapiens
GSGSTFKAS

SEQ ID NO: 1399686 - protein, 9 aa, Homo Sapiens
NFKWVFKVV

SEQ ID NO: 1399687 - protein, 9 aa, Homo Sapiens
FHCREECQI

SEQ ID NO: 1399688 - protein, 9 aa, Homo Sapiens
YYMLGNGDI

SEQ ID NO: 1399689 - protein, 9 aa, Homo Sapiens
HCREECQIL

SEQ ID NO: 1399690 - protein, 9 aa, Homo Sapiens
HWMLSRDRA

SEQ ID NO: 1399691 - protein, 9 aa, Homo Sapiens
HVELSPMQK

SEQ ID NO: 1399692 - protein, 9 aa, Homo Sapiens
LHWMLSRDR

SEQ ID NO: 1399693 - protein, 9 aa, Homo Sapiens
WTLHWMLSR

SEQ ID NO: 1399694 - protein, 9 aa, Homo Sapiens
MLNLKVQPL

SEQ ID NO: 1399695 - protein, 9 aa, Homo Sapiens
TPTPGPAHG

SEQ ID NO: 1399696 - protein, 9 aa, Homo Sapiens
KGVPRTFKE

SEQ ID NO: 1399697 - protein, 9 aa, Homo Sapiens
DAPGPAASC

SEQ ID NO: 1399698 - protein, 9 aa, Homo Sapiens
LIVHVELSP

SEQ ID NO: 1399699 - protein, 9 aa, Homo Sapiens
SPLSRAAAA

SEQ ID NO: 1399700 - protein, 9 aa, Homo Sapiens
KKNEVHETF

SEQ ID NO: 1399701 - protein, 9 aa, Homo Sapiens
QFDNFKWVF

SEQ ID NO: 1399702 - protein, 9 aa, Homo Sapiens
PSPCPGPGP

SEQ ID NO: 1399703 - protein, 9 aa, Homo Sapiens
FIFHILGTP

SEQ ID NO: 1399704 - protein, 9 aa, Homo Sapiens
LYIACRQKG

SEQ ID NO: 1399705 - protein, 9 aa, Homo Sapiens
KETDPVKIP

SEQ ID NO: 1399706 - protein, 9 aa, Homo Sapiens
STREQIAVW

SEQ ID NO: 1399707 - protein, 9 aa, Homo Sapiens
IHAVSQQRQ

SEQ ID NO: 1399708 - protein, 9 aa, Homo Sapiens
QERAIVPLE

SEQ ID NO: 1399709 - protein, 9 aa, Homo Sapiens
ANMTELVDL

SEQ ID NO: 1399710 - protein, 9 aa, Homo Sapiens
TELVDLTLS

SEQ ID NO: 1399711 - protein, 9 aa, Homo Sapiens
PMDIHAVSQ

SEQ ID NO: 1399712 - protein, 9 aa, Homo Sapiens
PTPGPAHGP

SEQ ID NO: 1399713 - protein, 9 aa, Homo Sapiens
LNLKVQPLT

SEQ ID NO: 1399714 - protein, 9 aa, Homo Sapiens
NCETRCGQI

SEQ ID NO: 1399715 - protein, 9 aa, Homo Sapiens
CPGPGPSPG

SEQ ID NO: 1399716 - protein, 9 aa, Homo Sapiens
MDIHAVSQQ

SEQ ID NO: 1399717 - protein, 9 aa, Homo Sapiens
ISLCNMERS

SEQ ID NO: 1399718 - protein, 9 aa, Homo Sapiens
ALEISLCNM

SEQ ID NO: 1399719 - protein, 9 aa, Homo Sapiens
VDHYNISSI

SEQ ID NO: 1399720 - protein, 9 aa, Homo Sapiens
IACRQKGVP

SEQ ID NO: 1399721 - protein, 9 aa, Homo Sapiens
IFHILGTPT

SEQ ID NO: 1399722 - protein, 9 aa, Homo Sapiens
NLKVQPLTL

SEQ ID NO: 1399723 - protein, 9 aa, Homo Sapiens
TLDYYMLGN

SEQ ID NO: 1399724 - protein, 9 aa, Homo Sapiens
LCNMERSRE

SEQ ID NO: 1399725 - protein, 9 aa, Homo Sapiens
GMVTASMDS

SEQ ID NO: 1399726 - protein, 9 aa, Homo Sapiens
TYVIVNIRD

SEQ ID NO: 1399727 - protein, 9 aa, Homo Sapiens
MTELVDLTL

SEQ ID NO: 1399728 - protein, 9 aa, Homo Sapiens
AGMVTASMD

SEQ ID NO: 1399729 - protein, 9 aa, Homo Sapiens
GSTFKASQD

SEQ ID NO: 1399730 - protein, 9 aa, Homo Sapiens
PGPAASCTG

SEQ ID NO: 1399731 - protein, 9 aa, Homo Sapiens
MVTASMDSG

SEQ ID NO: 1399732 - protein, 9 aa, Homo Sapiens
ETRCGQILL

SEQ ID NO: 1399733 - protein, 9 aa, Homo Sapiens
AVSQQRQPN

SEQ ID NO: 1399734 - protein, 9 aa, Homo Sapiens
RMVRRAAAS

SEQ ID NO: 1399735 - protein, 9 aa, Homo Sapiens
YLEAGMVTA

SEQ ID NO: 1399736 - protein, 9 aa, Homo Sapiens
EIKAAQERA

SEQ ID NO: 1399737 - protein, 9 aa, Homo Sapiens
EECQILGHS

SEQ ID NO: 1399738 - protein, 9 aa, Homo Sapiens
KPAMLNLKV

SEQ ID NO: 1399739 - protein, 9 aa, Homo Sapiens
ENTIFDAKR

SEQ ID NO: 1399740 - protein, 9 aa, Homo Sapiens
CATYVIVNI

SEQ ID NO: 1399741 - protein, 9 aa, Homo Sapiens
LTPKEAFWQ

SEQ ID NO: 1399742 - protein, 9 aa, Homo Sapiens
TTPTPGPAH

SEQ ID NO: 1399743 - protein, 9 aa, Homo Sapiens
VHVELSPMQ

SEQ ID NO: 1399744 - protein, 9 aa, Homo Sapiens
AVDHYNISS

SEQ ID NO: 1399745 - protein, 9 aa, Homo Sapiens
VKIPPLPEH

SEQ ID NO: 1399746 - protein, 9 aa, Homo Sapiens
DMSTREQIA

SEQ ID NO: 1399747 - protein, 9 aa, Homo Sapiens
EAGMVTASM

SEQ ID NO: 1399748 - protein, 9 aa, Homo Sapiens
EAFWQLSHR

SEQ ID NO: 1399749 - protein, 9 aa, Homo Sapiens
PAMLNLKVQ

SEQ ID NO: 1399750 - protein, 9 aa, Homo Sapiens
VSQQRQPNA

SEQ ID NO: 1399751 - protein, 9 aa, Homo Sapiens
WVFKVVEEM

SEQ ID NO: 1399752 - protein, 9 aa, Homo Sapiens
PDMSTREQI

SEQ ID NO: 1399753 - protein, 9 aa, Homo Sapiens
AALEISLCN

SEQ ID NO: 1399754 - protein, 9 aa, Homo Sapiens
FANMTELVD

SEQ ID NO: 1399755 - protein, 9 aa, Homo Sapiens
VHNGEVRTA

SEQ ID NO: 1399756 - protein, 9 aa, Homo Sapiens
ATYVIVNIR

SEQ ID NO: 1399757 - protein, 9 aa, Homo Sapiens
PGLFGVWVH

SEQ ID NO: 1399758 - protein, 9 aa, Homo Sapiens
SLCNMERSR

SEQ ID NO: 1399759 - protein, 9 aa, Homo Sapiens
IDENLSSIM

SEQ ID NO: 1399760 - protein, 9 aa, Homo Sapiens
HRFHRIFAI

SEQ ID NO: 1399761 - protein, 9 aa, Homo Sapiens
RMTTKLIRL

SEQ ID NO: 1399762 - protein, 9 aa, Homo Sapiens
SKRGPSHAP

SEQ ID NO: 1399763 - protein, 9 aa, Homo Sapiens
LHNCETRCG

SEQ ID NO: 1399764 - protein, 9 aa, Homo Sapiens
EQLHFIFHI

SEQ ID NO: 1399765 - protein, 9 aa, Homo Sapiens
ILCATYVIV

SEQ ID NO: 1399766 - protein, 9 aa, Homo Sapiens
KIPPLPEHQ

SEQ ID NO: 1399767 - protein, 9 aa, Homo Sapiens
GGMNWRPIL

SEQ ID NO: 1399768 - protein, 9 aa, Homo Sapiens
HGSGSTFKA

SEQ ID NO: 1399769 - protein, 9 aa, Homo Sapiens
DSHGSGSTF

SEQ ID NO: 1399770 - protein, 9 aa, Homo Sapiens
IFAIDENLS

SEQ ID NO: 1399771 - protein, 9 aa, Homo Sapiens
SHGSGSTFK

SEQ ID NO: 1399772 - protein, 9 aa, Homo Sapiens
MKKNEVHET

SEQ ID NO: 1399773 - protein, 9 aa, Homo Sapiens
VHETFSYPE

SEQ ID NO: 1399774 - protein, 9 aa, Homo Sapiens
SWARTSPLS

SEQ ID NO: 1399775 - protein, 9 aa, Homo Sapiens
LCATYVIVN

SEQ ID NO: 1399776 - protein, 9 aa, Homo Sapiens
ASCTGVFPY

SEQ ID NO: 1399777 - protein, 9 aa, Homo Sapiens
NEVHETFSY

SEQ ID NO: 1399778 - protein, 9 aa, Homo Sapiens
PENTIFDAK

SEQ ID NO: 1399779 - protein, 9 aa, Homo Sapiens
AIDENLSSI

SEQ ID NO: 1399780 - protein, 9 aa, Homo Sapiens
FHRIFAIDE

SEQ ID NO: 1399781 - protein, 9 aa, Homo Sapiens
CGQILLWSG

SEQ ID NO: 1399782 - protein, 9 aa, Homo Sapiens
HNCETRCGQ

SEQ ID NO: 1399783 - protein, 9 aa, Homo Sapiens
CRQKGVPRT

SEQ ID NO: 1399784 - protein, 9 aa, Homo Sapiens
RNLCSDDTR

SEQ ID NO: 1399785 - protein, 9 aa, Homo Sapiens
RGPSHAPFL

SEQ ID NO: 1399786 - protein, 9 aa, Homo Sapiens
AQHLWTLHW

SEQ ID NO: 1399787 - protein, 9 aa, Homo Sapiens
LCVYLEAGM

SEQ ID NO: 1399788 - protein, 9 aa, Homo Sapiens
TLHWMLSRD

SEQ ID NO: 1399789 - protein, 9 aa, Homo Sapiens
RQDFANMTE

SEQ ID NO: 1399790 - protein, 9 aa, Homo Sapiens
DHYNISSIY

SEQ ID NO: 1399791 - protein, 9 aa, Homo Sapiens
PGSKRGPSH

SEQ ID NO: 1399792 - protein, 9 aa, Homo Sapiens
DYYMLGNGD

SEQ ID NO: 1399793 - protein, 9 aa, Homo Sapiens
EPGLFGVWV

SEQ ID NO: 1399794 - protein, 9 aa, Homo Sapiens
TTKLIRLVN

SEQ ID NO: 1399795 - protein, 9 aa, Homo Sapiens
DPVKIPPLP

SEQ ID NO: 1399796 - protein, 9 aa, Homo Sapiens
NISSIYFLA

SEQ ID NO: 1399797 - protein, 9 aa, Homo Sapiens
VWVHNGEVR

SEQ ID NO: 1399798 - protein, 9 aa, Homo Sapiens
YPDMSTREQ

SEQ ID NO: 1399799 - protein, 9 aa, Homo Sapiens
ARTSPLSRA

SEQ ID NO: 1399800 - protein, 9 aa, Homo Sapiens
FWQLSHRFH

SEQ ID NO: 1399801 - protein, 9 aa, Homo Sapiens
SDDTRMVRR

SEQ ID NO: 1399802 - protein, 9 aa, Homo Sapiens
GFHCREECQ

SEQ ID NO: 1399803 - protein, 9 aa, Homo Sapiens
EQIAVWTNL

SEQ ID NO: 1399804 - protein, 9 aa, Homo Sapiens
AEIKAAQER

SEQ ID NO: 1399805 - protein, 9 aa, Homo Sapiens
FKWVFKVVE

SEQ ID NO: 1399806 - protein, 9 aa, Homo Sapiens
NMTELVDLT

SEQ ID NO: 1399807 - protein, 9 aa, Homo Sapiens
VYLEAGMVT

SEQ ID NO: 1399808 - protein, 9 aa, Homo Sapiens
NPENTIFDA

SEQ ID NO: 1399809 - protein, 9 aa, Homo Sapiens
AFWQLSHRF

SEQ ID NO: 1399810 - protein, 9 aa, Homo Sapiens
RTSPLSRAA

SEQ ID NO: 1399811 - protein, 9 aa, Homo Sapiens
WVHNGEVRT

SEQ ID NO: 1399812 - protein, 9 aa, Homo Sapiens
DNFKWVFKV

SEQ ID NO: 1399813 - protein, 9 aa, Homo Sapiens
CTGVFPYHV

SEQ ID NO: 1399814 - protein, 9 aa, Homo Sapiens
YVIVNIRDI

SEQ ID NO: 1399815 - protein, 9 aa, Homo Sapiens
RRQFDNFKW

SEQ ID NO: 1399816 - protein, 9 aa, Homo Sapiens
NLCSDDTRM

SEQ ID NO: 1399817 - protein, 9 aa, Homo Sapiens
MSTREQIAV

SEQ ID NO: 1399818 - protein, 9 aa, Homo Sapiens
TREQIAVWT

SEQ ID NO: 1399819 - protein, 9 aa, Homo Sapiens
LTSNPENTI

SEQ ID NO: 1399820 - protein, 9 aa, Homo Sapiens
MTTKLIRLV

SEQ ID NO: 1399821 - protein, 9 aa, Homo Sapiens
AAQERAIVP

SEQ ID NO: 1399822 - protein, 9 aa, Homo Sapiens
LAQHLWTLH

SEQ ID NO: 1399823 - protein, 9 aa, Homo Sapiens
GLFGVWVHN

SEQ ID NO: 1399824 - protein, 9 aa, Homo Sapiens
FAIDENLSS

SEQ ID NO: 1399825 - protein, 9 aa, Homo Sapiens
QLHFIFHIL

SEQ ID NO: 1399826 - protein, 9 aa, Homo Sapiens
RCGQILLWS

SEQ ID NO: 1399827 - protein, 9 aa, Homo Sapiens
PSKTELIVH

SEQ ID NO: 1399828 - protein, 9 aa, Homo Sapiens
YMLGNGDIL

SEQ ID NO: 1399829 - protein, 9 aa, Homo Sapiens
APGPAASCT

SEQ ID NO: 1399830 - protein, 9 aa, Homo Sapiens
AQERAIVPL

SEQ ID NO: 1399831 - protein, 9 aa, Homo Sapiens
ACRQKGVPR

SEQ ID NO: 1399832 - protein, 9 aa, Homo Sapiens
TRMVRRAAA

SEQ ID NO: 1399833 - protein, 9 aa, Homo Sapiens
PVKIPPLPE

SEQ ID NO: 1399834 - protein, 9 aa, Homo Sapiens
LSRAAAAAP

SEQ ID NO: 1399835 - protein, 9 aa, Homo Sapiens
PLSRAAAAA

SEQ ID NO: 1399836 - protein, 9 aa, Homo Sapiens
QILGHSDRC

SEQ ID NO: 1399837 - protein, 9 aa, Homo Sapiens
PSHAPFLSR

SEQ ID NO: 1399838 - protein, 9 aa, Homo Sapiens
GPSPCPGPG

SEQ ID NO: 1399839 - protein, 9 aa, Homo Sapiens
HETFSYPES

SEQ ID NO: 1399840 - protein, 9 aa, Homo Sapiens
SGSTFKASQ

SEQ ID NO: 1399841 - protein, 9 aa, Homo Sapiens
KRGPSHAPF

SEQ ID NO: 1399842 - protein, 9 aa, Homo Sapiens
IKAAQERAI

SEQ ID NO: 1399843 - protein, 9 aa, Homo Sapiens
PAASCTGVF

SEQ ID NO: 1399844 - protein, 9 aa, Homo Sapiens
HILGTPTEE

SEQ ID NO: 1399845 - protein, 9 aa, Homo Sapiens
WRPILTIIT

SEQ ID NO: 1399846 - protein, 9 aa, Homo Sapiens
TRCGQILLW

SEQ ID NO: 1399847 - protein, 9 aa, Homo Sapiens
AMLNLKVQP

SEQ ID NO: 1399848 - protein, 9 aa, Homo Sapiens
ELVDLTLSR

SEQ ID NO: 1399849 - protein, 9 aa, Homo Sapiens
CLYIACRQK

SEQ ID NO: 1399850 - protein, 9 aa, Homo Sapiens
TDPVKIPPL

SEQ ID NO: 1399851 - protein, 9 aa, Homo Sapiens
LAKPAMLNL

SEQ ID NO: 1399852 - protein, 9 aa, Homo Sapiens
PKEAFWQLS

SEQ ID NO: 1399853 - protein, 9 aa, Homo Sapiens
PCPGPGPSP

SEQ ID NO: 1399854 - protein, 9 aa, Homo Sapiens
FGVWVHNGE

SEQ ID NO: 1399855 - protein, 9 aa, Homo Sapiens
GVWVHNGEV

SEQ ID NO: 1399856 - protein, 9 aa, Homo Sapiens
LDYYMLGNG

SEQ ID NO: 1399857 - protein, 9 aa, Homo Sapiens
QKGVPRTFK

SEQ ID NO: 1399858 - protein, 9 aa, Homo Sapiens
IVNIRDIDK

SEQ ID NO: 1399859 - protein, 9 aa, Homo Sapiens
EAEIKAAQE

SEQ ID NO: 1399860 - protein, 9 aa, Homo Sapiens
LWTLHWMLS

SEQ ID NO: 1399861 - protein, 9 aa, Homo Sapiens
CREECQILG

SEQ ID NO: 1399862 - protein, 9 aa, Homo Sapiens
LHFIFHILG

SEQ ID NO: 1399863 - protein, 9 aa, Homo Sapiens
QEDKIKRMT

SEQ ID NO: 1399864 - protein, 9 aa, Homo Sapiens
TELIVHVEL

SEQ ID NO: 1399865 - protein, 9 aa, Homo Sapiens
SCTGVFPYH

SEQ ID NO: 1399866 - protein, 9 aa, Homo Sapiens
EDSHGSGST

SEQ ID NO: 1399867 - protein, 9 aa, Homo Sapiens
LKVQPLTLA

SEQ ID NO: 1399868 - protein, 9 aa, Homo Sapiens
SCMGGMNWR

SEQ ID NO: 1399869 - protein, 9 aa, Homo Sapiens
RLPGSKRGP

SEQ ID NO: 1399870 - protein, 9 aa, Homo Sapiens
RQKGVPRTF

SEQ ID NO: 1399871 - protein, 9 aa, Homo Sapiens
LPGSKRGPS

SEQ ID NO: 1399872 - protein, 9 aa, Homo Sapiens
LEISLCNME

SEQ ID NO: 1399873 - protein, 9 aa, Homo Sapiens
AASCTGVFP

SEQ ID NO: 1399874 - protein, 9 aa, Homo Sapiens
QIAVWTNLT

SEQ ID NO: 1399875 - protein, 9 aa, Homo Sapiens
PFTTPTPGP

SEQ ID NO: 1399876 - protein, 9 aa, Homo Sapiens
KMKKNEVHE

SEQ ID NO: 1399877 - protein, 9 aa, Homo Sapiens
DKIKRMTTK

SEQ ID NO: 1399878 - protein, 9 aa, Homo Sapiens
IVHVELSPM

SEQ ID NO: 1399879 - protein, 9 aa, Homo Sapiens
GNGDILEYK

SEQ ID NO: 1399880 - protein, 9 aa, Homo Sapiens
ALPFTTPTP

SEQ ID NO: 1399881 - protein, 9 aa, Homo Sapiens
FTTPTPGPA

SEQ ID NO: 1399882 - protein, 9 aa, Homo Sapiens
MNWRPILTI

SEQ ID NO: 1399883 - protein, 9 aa, Homo Sapiens
SPMDIHAVS

SEQ ID NO: 1399884 - protein, 9 aa, Homo Sapiens
REECQILGH

SEQ ID NO: 1399885 - protein, 9 aa, Homo Sapiens
MGGMNWRPI

SEQ ID NO: 1399886 - protein, 9 aa, Homo Sapiens
HLWTLHWML

SEQ ID NO: 1399887 - protein, 9 aa, Homo Sapiens
TPKEAFWQL

SEQ ID NO: 1399888 - protein, 9 aa, Homo Sapiens
GSKRGPSHA

SEQ ID NO: 1399889 - protein, 9 aa, Homo Sapiens
KLTPKEAFW

SEQ ID NO: 1399890 - protein, 9 aa, Homo Sapiens
RFHRIFAID

SEQ ID NO: 1399891 - protein, 9 aa, Homo Sapiens
DIHAVSQQR

SEQ ID NO: 1399892 - protein, 9 aa, Homo Sapiens
EEQLHFIFH

SEQ ID NO: 1399893 - protein, 9 aa, Homo Sapiens
LFGVWVHNG

SEQ ID NO: 1399894 - protein, 9 aa, Homo Sapiens
SPCPGPGPS

SEQ ID NO: 1399895 - protein, 9 aa, Homo Sapiens
WQLSHRFHG

SEQ ID NO: 1399896 - protein, 9 aa, Homo Sapiens
RTLDYYMLG

SEQ ID NO: 1399897 - protein, 9 aa, Homo Sapiens
FSPMDIHAV

SEQ ID NO: 1399898 - protein, 9 aa, Homo Sapiens
LALGAVDPQ

SEQ ID NO: 1399899 - protein, 9 aa, Homo Sapiens
YNIANNKDA

SEQ ID NO: 1399900 - protein, 9 aa, Homo Sapiens
VTAEYEDGS

SEQ ID NO: 1399901 - protein, 9 aa, Homo Sapiens
TMWLSFSLP

SEQ ID NO: 1399902 - protein, 9 aa, Homo Sapiens
VLRDVAAEA

SEQ ID NO: 1399903 - protein, 9 aa, Homo Sapiens
TSKVIPPIL

SEQ ID NO: 1399904 - protein, 9 aa, Homo Sapiens
KCKYCSKVL

SEQ ID NO: 1399905 - protein, 9 aa, Homo Sapiens
LIEDLELQI

SEQ ID NO: 1399906 - protein, 9 aa, Homo Sapiens
GSTETTTLP

SEQ ID NO: 1399907 - protein, 9 aa, Homo Sapiens
LKDLLHLDM

SEQ ID NO: 1399908 - protein, 9 aa, Homo Sapiens
EDAVGEPRW

SEQ ID NO: 1399909 - protein, 9 aa, Homo Sapiens
LLKYGVHKI

SEQ ID NO: 1399910 - protein, 9 aa, Homo Sapiens
LRDSLPPHE

SEQ ID NO: 1399911 - protein, 9 aa, Homo Sapiens
AHHDHNCRS

SEQ ID NO: 1399912 - protein, 9 aa, Homo Sapiens
SCLKQDPPV

SEQ ID NO: 1399913 - protein, 9 aa, Homo Sapiens
GERDCRDNR

SEQ ID NO: 1399914 - protein, 9 aa, Homo Sapiens
DISILNEHV

SEQ ID NO: 1399915 - protein, 9 aa, Homo Sapiens
YKKTYMEMH

SEQ ID NO: 1399916 - protein, 9 aa, Homo Sapiens
HDSLTNCTF

SEQ ID NO: 1399917 - protein, 9 aa, Homo Sapiens
GGAEGQPPG

SEQ ID NO: 1399918 - protein, 9 aa, Homo Sapiens
DTTTKRYHQ

SEQ ID NO: 1399919 - protein, 9 aa, Homo Sapiens
LDSPDFHER

SEQ ID NO: 1399920 - protein, 9 aa, Homo Sapiens
IDKEATICQ

SEQ ID NO: 1399921 - protein, 9 aa, Homo Sapiens
EATICQNNE

SEQ ID NO: 1399922 - protein, 9 aa, Homo Sapiens
PRSRTASAS

SEQ ID NO: 1399923 - protein, 9 aa, Homo Sapiens
SKEEPVSSW

SEQ ID NO: 1399924 - protein, 9 aa, Homo Sapiens
KCHNKQVEG

SEQ ID NO: 1399925 - protein, 9 aa, Homo Sapiens
WCPPGTTAS

SEQ ID NO: 1399926 - protein, 9 aa, Homo Sapiens
LLPASWFLS

SEQ ID NO: 1399927 - protein, 9 aa, Homo Sapiens
KSSGCTYQD

SEQ ID NO: 1399928 - protein, 9 aa, Homo Sapiens
RGQLPGLLP

SEQ ID NO: 1399929 - protein, 9 aa, Homo Sapiens
NICQICFNS

SEQ ID NO: 1399930 - protein, 9 aa, Homo Sapiens
AIGATVILL

SEQ ID NO: 1399931 - protein, 9 aa, Homo Sapiens
GGVAPRCPR

SEQ ID NO: 1399932 - protein, 9 aa, Homo Sapiens
LRRTPALTS

SEQ ID NO: 1399933 - protein, 9 aa, Homo Sapiens
SVSPPQAAG

SEQ ID NO: 1399934 - protein, 9 aa, Homo Sapiens
ALNAVDNLV

SEQ ID NO: 1399935 - protein, 9 aa, Homo Sapiens
LLLQPSSLT

SEQ ID NO: 1399936 - protein, 9 aa, Homo Sapiens
ASKSQTVGS

SEQ ID NO: 1399937 - protein, 9 aa, Homo Sapiens
DIGQSEQKA

SEQ ID NO: 1399938 - protein, 9 aa, Homo Sapiens
QDRMVERIQ

SEQ ID NO: 1399939 - protein, 9 aa, Homo Sapiens
NSNPPVWYS

SEQ ID NO: 1399940 - protein, 9 aa, Homo Sapiens
HAKYDVIDK

SEQ ID NO: 1399941 - protein, 9 aa, Homo Sapiens
SKLTKVQAE

SEQ ID NO: 1399942 - protein, 9 aa, Homo Sapiens
VHHVAGQAG

SEQ ID NO: 1399943 - protein, 9 aa, Homo Sapiens
STHNGNNAV

SEQ ID NO: 1399944 - protein, 9 aa, Homo Sapiens
LIEEFGQLK

SEQ ID NO: 1399945 - protein, 9 aa, Homo Sapiens
KENLKDTTT

SEQ ID NO: 1399946 - protein, 9 aa, Homo Sapiens
RVVTLENYT

SEQ ID NO: 1399947 - protein, 9 aa, Homo Sapiens
KPWWWHLCV

SEQ ID NO: 1399948 - protein, 9 aa, Homo Sapiens
LPLEIALTI

SEQ ID NO: 1399949 - protein, 9 aa, Homo Sapiens
CFSFSGHPT

SEQ ID NO: 1399950 - protein, 9 aa, Homo Sapiens
VHAAPSAQR

SEQ ID NO: 1399951 - protein, 9 aa, Homo Sapiens
EGLARLCQS

SEQ ID NO: 1399952 - protein, 9 aa, Homo Sapiens
CHTELNAIM

SEQ ID NO: 1399953 - protein, 9 aa, Homo Sapiens
HPSAFNNLK

SEQ ID NO: 1399954 - protein, 9 aa, Homo Sapiens
SQRPRPTKN

SEQ ID NO: 1399955 - protein, 9 aa, Homo Sapiens
MWRQCSDCP

SEQ ID NO: 1399956 - protein, 9 aa, Homo Sapiens
AQDVEPNHF

SEQ ID NO: 1399957 - protein, 9 aa, Homo Sapiens
ESPWQVMAS

SEQ ID NO: 1399958 - protein, 9 aa, Homo Sapiens
VSPPQAAGA

SEQ ID NO: 1399959 - protein, 9 aa, Homo Sapiens
APLRLWSWC

SEQ ID NO: 1399960 - protein, 9 aa, Homo Sapiens
HLPGSDPPA

SEQ ID NO: 1399961 - protein, 9 aa, Homo Sapiens
IWDHLSTVY

SEQ ID NO: 1399962 - protein, 9 aa, Homo Sapiens
EQARRKQQE

SEQ ID NO: 1399963 - protein, 9 aa, Homo Sapiens
VVLEHLRPS

SEQ ID NO: 1399964 - protein, 9 aa, Homo Sapiens
FHWVLSQPQ

SEQ ID NO: 1399965 - protein, 9 aa, Homo Sapiens
TKNTREGGW

SEQ ID NO: 1399966 - protein, 9 aa, Homo Sapiens
IKKVITVYV

SEQ ID NO: 1399967 - protein, 9 aa, Homo Sapiens
RGSSPLPRS

SEQ ID NO: 1399968 - protein, 9 aa, Homo Sapiens
RGRAAARWS

SEQ ID NO: 1399969 - protein, 9 aa, Homo Sapiens
NSLKQIHLH

SEQ ID NO: 1399970 - protein, 9 aa, Homo Sapiens
IFMRHGCHM

SEQ ID NO: 1399971 - protein, 9 aa, Homo Sapiens
IMSELKMVT

SEQ ID NO: 1399972 - protein, 9 aa, Homo Sapiens
ECDKVFERS

SEQ ID NO: 1399973 - protein, 9 aa, Homo Sapiens
KRYVGSIDI

SEQ ID NO: 1399974 - protein, 9 aa, Homo Sapiens
PDFHERLKC

SEQ ID NO: 1399975 - protein, 9 aa, Homo Sapiens
VGADGVGKS

SEQ ID NO: 1399976 - protein, 9 aa, Homo Sapiens
LCLTRIRDR

SEQ ID NO: 1399977 - protein, 9 aa, Homo Sapiens
SVCPRSRTA

SEQ ID NO: 1399978 - protein, 9 aa, Homo Sapiens
VRCALWIPE

SEQ ID NO: 1399979 - protein, 9 aa, Homo Sapiens
EKEGIVKNL

SEQ ID NO: 1399980 - protein, 9 aa, Homo Sapiens
VARWVVFCQ

SEQ ID NO: 1399981 - protein, 9 aa, Homo Sapiens
SNSVGTTSD

SEQ ID NO: 1399982 - protein, 9 aa, Homo Sapiens
SQSGSPIGA

SEQ ID NO: 1399983 - protein, 9 aa, Homo Sapiens
RAKKWVLRK

SEQ ID NO: 1399984 - protein, 9 aa, Homo Sapiens
EKMGNFLAK

SEQ ID NO: 1399985 - protein, 9 aa, Homo Sapiens
VPSKWITHL

SEQ ID NO: 1399986 - protein, 9 aa, Homo Sapiens
VQPQSPSHE

SEQ ID NO: 1399987 - protein, 9 aa, Homo Sapiens
KYPQDNHEH

SEQ ID NO: 1399988 - protein, 9 aa, Homo Sapiens
RMLPLKQIA

SEQ ID NO: 1399989 - protein, 9 aa, Homo Sapiens
PVWYSWRRG

SEQ ID NO: 1399990 - protein, 9 aa, Homo Sapiens
RTSGNSWQV

SEQ ID NO: 1399991 - protein, 9 aa, Homo Sapiens
RHRKVYTEE

SEQ ID NO: 1399992 - protein, 9 aa, Homo Sapiens
DSNHTEFVI

SEQ ID NO: 1399993 - protein, 9 aa, Homo Sapiens
TTASSPECG

SEQ ID NO: 1399994 - protein, 9 aa, Homo Sapiens
IGQSEQKAD

SEQ ID NO: 1399995 - protein, 9 aa, Homo Sapiens
EAELRGMMS

SEQ ID NO: 1399996 - protein, 9 aa, Homo Sapiens
QAESKYTFE

SEQ ID NO: 1399997 - protein, 9 aa, Homo Sapiens
TNQSPIEFP

SEQ ID NO: 1399998 - protein, 9 aa, Homo Sapiens
NKEVKGPGR

SEQ ID NO: 1399999 - protein, 9 aa, Homo Sapiens
DSTNFLFLS

SEQ ID NO: 1400000 - protein, 9 aa, Homo Sapiens
FPTTESGAA

SEQ ID NO: 1400001 - protein, 9 aa, Homo Sapiens
PPGPPWGLS

SEQ ID NO: 1400002 - protein, 9 aa, Homo Sapiens
QAPLRLWSW

SEQ ID NO: 1400003 - protein, 9 aa, Homo Sapiens
ICQICFNSQ

SEQ ID NO: 1400004 - protein, 9 aa, Homo Sapiens
QPAARATWS

SEQ ID NO: 1400005 - protein, 9 aa, Homo Sapiens
GPTSPSLAS

SEQ ID NO: 1400006 - protein, 9 aa, Homo Sapiens
TVFLNPVAC

SEQ ID NO: 1400007 - protein, 9 aa, Homo Sapiens
AAPSAQRAE

SEQ ID NO: 1400008 - protein, 9 aa, Homo Sapiens
CICGAIVRP

SEQ ID NO: 1400009 - protein, 9 aa, Homo Sapiens
IQLCQEQFL

SEQ ID NO: 1400010 - protein, 9 aa, Homo Sapiens
EREQFLVAS

SEQ ID NO: 1400011 - protein, 9 aa, Homo Sapiens
SQGSQNFAL

SEQ ID NO: 1400012 - protein, 9 aa, Homo Sapiens
LCTISFRQS

SEQ ID NO: 1400013 - protein, 9 aa, Homo Sapiens
AVSAALWPL

SEQ ID NO: 1400014 - protein, 9 aa, Homo Sapiens
VAENNLCNQ

SEQ ID NO: 1400015 - protein, 9 aa, Homo Sapiens
PEPCLWVVP

SEQ ID NO: 1400016 - protein, 9 aa, Homo Sapiens
MRPISGVAL

SEQ ID NO: 1400017 - protein, 9 aa, Homo Sapiens
VPPPVLFKA

SEQ ID NO: 1400018 - protein, 9 aa, Homo Sapiens
LNPVLEMMP

SEQ ID NO: 1400019 - protein, 9 aa, Homo Sapiens
FGNMANNFT

SEQ ID NO: 1400020 - protein, 9 aa, Homo Sapiens
QVEGHVQLS

SEQ ID NO: 1400021 - protein, 9 aa, Homo Sapiens
LFHRWGHWM

SEQ ID NO: 1400022 - protein, 9 aa, Homo Sapiens
TGYVKIHHS

SEQ ID NO: 1400023 - protein, 9 aa, Homo Sapiens
GSSPLPRSF

SEQ ID NO: 1400024 - protein, 9 aa, Homo Sapiens
KAVGCCHTF

SEQ ID NO: 1400025 - protein, 9 aa, Homo Sapiens
ENQANNLLC

SEQ ID NO: 1400026 - protein, 9 aa, Homo Sapiens
TSTVHVVNA

SEQ ID NO: 1400027 - protein, 9 aa, Homo Sapiens
CIVCGKAFP

SEQ ID NO: 1400028 - protein, 9 aa, Homo Sapiens
ALFLEVILP

SEQ ID NO: 1400029 - protein, 9 aa, Homo Sapiens
GRFGLLASR

SEQ ID NO: 1400030 - protein, 9 aa, Homo Sapiens
NWGHLDRVA

SEQ ID NO: 1400031 - protein, 9 aa, Homo Sapiens
LRKDHVRQF

SEQ ID NO: 1400032 - protein, 9 aa, Homo Sapiens
WFDAHGPKY

SEQ ID NO: 1400033 - protein, 9 aa, Homo Sapiens
LVKVKQPPL

SEQ ID NO: 1400034 - protein, 9 aa, Homo Sapiens
NLRMLPLKQ

SEQ ID NO: 1400035 - protein, 9 aa, Homo Sapiens
PKTNKTMGF

SEQ ID NO: 1400036 - protein, 9 aa, Homo Sapiens
FGHMETVNL

SEQ ID NO: 1400037 - protein, 9 aa, Homo Sapiens
WRKLTIFSQ

SEQ ID NO: 1400038 - protein, 9 aa, Homo Sapiens
VINMGNSLI

SEQ ID NO: 1400039 - protein, 9 aa, Homo Sapiens
ERRHGERDC

SEQ ID NO: 1400040 - protein, 9 aa, Homo Sapiens
FRDRNTRIL

SEQ ID NO: 1400041 - protein, 9 aa, Homo Sapiens
PKFCRTTEN

SEQ ID NO: 1400042 - protein, 9 aa, Homo Sapiens
TGALSLKKS

SEQ ID NO: 1400043 - protein, 9 aa, Homo Sapiens
EQHQLQKPP

SEQ ID NO: 1400044 - protein, 9 aa, Homo Sapiens
FQWGESPWQ

SEQ ID NO: 1400045 - protein, 9 aa, Homo Sapiens
SIPRYVRDI

SEQ ID NO: 1400046 - protein, 9 aa, Homo Sapiens
KALSTCTAR

SEQ ID NO: 1400047 - protein, 9 aa, Homo Sapiens
LAGHGASLQ

SEQ ID NO: 1400048 - protein, 9 aa, Homo Sapiens
LNKKWVWRI

SEQ ID NO: 1400049 - protein, 9 aa, Homo Sapiens
CTALSSYAR

SEQ ID NO: 1400050 - protein, 9 aa, Homo Sapiens
PLRLQPPKA

SEQ ID NO: 1400051 - protein, 9 aa, Homo Sapiens
SGHPTMWLS

SEQ ID NO: 1400052 - protein, 9 aa, Homo Sapiens
NSYGTFLCL

SEQ ID NO: 1400053 - protein, 9 aa, Homo Sapiens
YLTNQLMGL

SEQ ID NO: 1400054 - protein, 9 aa, Homo Sapiens
FGKVAMRYN

SEQ ID NO: 1400055 - protein, 9 aa, Homo Sapiens
SGSNPPIFH

SEQ ID NO: 1400056 - protein, 9 aa, Homo Sapiens
LGSNKSPAS

SEQ ID NO: 1400057 - protein, 9 aa, Homo Sapiens
CDIPPQGLK

SEQ ID NO: 1400058 - protein, 9 aa, Homo Sapiens
EIQEKLCLT

SEQ ID NO: 1400059 - protein, 9 aa, Homo Sapiens
TPAPLLAVS

SEQ ID NO: 1400060 - protein, 9 aa, Homo Sapiens
LRRSWRYRG

SEQ ID NO: 1400061 - protein, 9 aa, Homo Sapiens
GVHGFARSM

SEQ ID NO: 1400062 - protein, 9 aa, Homo Sapiens
HVVVCDINK

SEQ ID NO: 1400063 - protein, 9 aa, Homo Sapiens
LDCWDSPDG

SEQ ID NO: 1400064 - protein, 9 aa, Homo Sapiens
PSKQRGKMR

SEQ ID NO: 1400065 - protein, 9 aa, Homo Sapiens
QHFDPNTYL

SEQ ID NO: 1400066 - protein, 9 aa, Homo Sapiens
CLRALFLEV

SEQ ID NO: 1400067 - protein, 9 aa, Homo Sapiens
VLLPGVLIP

SEQ ID NO: 1400068 - protein, 9 aa, Homo Sapiens
QWHKHSSLQ

SEQ ID NO: 1400069 - protein, 9 aa, Homo Sapiens
FLDHFGNMA

SEQ ID NO: 1400070 - protein, 9 aa, Homo Sapiens
FRIASSVSP

SEQ ID NO: 1400071 - protein, 9 aa, Homo Sapiens
EHVQSLVCF

SEQ ID NO: 1400072 - protein, 9 aa, Homo Sapiens
RLVGLTDEI

SEQ ID NO: 1400073 - protein, 9 aa, Homo Sapiens
AEQAMTAIQ

SEQ ID NO: 1400074 - protein, 9 aa, Homo Sapiens
EYPLNLYLL

SEQ ID NO: 1400075 - protein, 9 aa, Homo Sapiens
SLKKSSRKD

SEQ ID NO: 1400076 - protein, 9 aa, Homo Sapiens
TTTACSVCP

SEQ ID NO: 1400077 - protein, 9 aa, Homo Sapiens
EIASALGHL

SEQ ID NO: 1400078 - protein, 9 aa, Homo Sapiens
GLGPDPPTG

SEQ ID NO: 1400079 - protein, 9 aa, Homo Sapiens
RNAKRMESI

SEQ ID NO: 1400080 - protein, 9 aa, Homo Sapiens
THCGPYETD

SEQ ID NO: 1400081 - protein, 9 aa, Homo Sapiens
NTEPAVDYT

SEQ ID NO: 1400082 - protein, 9 aa, Homo Sapiens
LSLKKSSRK

SEQ ID NO: 1400083 - protein, 9 aa, Homo Sapiens
LAYCSLSFP

SEQ ID NO: 1400084 - protein, 9 aa, Homo Sapiens
TKGISARGS

SEQ ID NO: 1400085 - protein, 9 aa, Homo Sapiens
DGQVLGRHC

SEQ ID NO: 1400086 - protein, 9 aa, Homo Sapiens
EVHDQDRKS

SEQ ID NO: 1400087 - protein, 9 aa, Homo Sapiens
EAEKKAQDV

SEQ ID NO: 1400088 - protein, 9 aa, Homo Sapiens
QPNSREEAQ

SEQ ID NO: 1400089 - protein, 9 aa, Homo Sapiens
LSAETTEPV

SEQ ID NO: 1400090 - protein, 9 aa, Homo Sapiens
IFYLIHPTN

SEQ ID NO: 1400091 - protein, 9 aa, Homo Sapiens
LGIKKVITV

SEQ ID NO: 1400092 - protein, 9 aa, Homo Sapiens
CQAVVQYMK

SEQ ID NO: 1400093 - protein, 9 aa, Homo Sapiens
RVSEKYLLA

SEQ ID NO: 1400094 - protein, 9 aa, Homo Sapiens
MFPWMVTRI

SEQ ID NO: 1400095 - protein, 9 aa, Homo Sapiens
GASRVDVMK

SEQ ID NO: 1400096 - protein, 9 aa, Homo Sapiens
QKVIQNIEQ

SEQ ID NO: 1400097 - protein, 9 aa, Homo Sapiens
PSWCPPGTT

SEQ ID NO: 1400098 - protein, 9 aa, Homo Sapiens
QLCQEQFLC

SEQ ID NO: 1400099 - protein, 9 aa, Homo Sapiens
SIKITNEPT

SEQ ID NO: 1400100 - protein, 9 aa, Homo Sapiens
QRSFWKRKS

SEQ ID NO: 1400101 - protein, 9 aa, Homo Sapiens
DNKKETEKS

SEQ ID NO: 1400102 - protein, 9 aa, Homo Sapiens
CAGPSWGPS

SEQ ID NO: 1400103 - protein, 9 aa, Homo Sapiens
VLVSSQFVR

SEQ ID NO: 1400104 - protein, 9 aa, Homo Sapiens
QAKKLHPQT

SEQ ID NO: 1400105 - protein, 9 aa, Homo Sapiens
QVSAQPAAR

SEQ ID NO: 1400106 - protein, 9 aa, Homo Sapiens
EGSTIEASD

SEQ ID NO: 1400107 - protein, 9 aa, Homo Sapiens
DCRDNRERD

SEQ ID NO: 1400108 - protein, 9 aa, Homo Sapiens
LGCLWSGPT

SEQ ID NO: 1400109 - protein, 9 aa, Homo Sapiens
TSGNSWQVH

SEQ ID NO: 1400110 - protein, 9 aa, Homo Sapiens
STCTARFIV

SEQ ID NO: 1400111 - protein, 9 aa, Homo Sapiens
GGRLVLKAI

SEQ ID NO: 1400112 - protein, 9 aa, Homo Sapiens
SNRCRIGFS

SEQ ID NO: 1400113 - protein, 9 aa, Homo Sapiens
KVAMRYNNQ

SEQ ID NO: 1400114 - protein, 9 aa, Homo Sapiens
VMALNRYVA

SEQ ID NO: 1400115 - protein, 9 aa, Homo Sapiens
CCRPCCRPA

SEQ ID NO: 1400116 - protein, 9 aa, Homo Sapiens
DDRSPQAPL

SEQ ID NO: 1400117 - protein, 9 aa, Homo Sapiens
DQDGKITWQ

SEQ ID NO: 1400118 - protein, 9 aa, Homo Sapiens
PRPTKNTRE

SEQ ID NO: 1400119 - protein, 9 aa, Homo Sapiens
APINAFIWG

SEQ ID NO: 1400120 - protein, 9 aa, Homo Sapiens
DCLCTALSS

SEQ ID NO: 1400121 - protein, 9 aa, Homo Sapiens
VYTEEKSHE

SEQ ID NO: 1400122 - protein, 9 aa, Homo Sapiens
SNEYGIGLS

SEQ ID NO: 1400123 - protein, 9 aa, Homo Sapiens
GTQQSLQAV

SEQ ID NO: 1400124 - protein, 9 aa, Homo Sapiens
RFIVVFLFF

SEQ ID NO: 1400125 - protein, 9 aa, Homo Sapiens
KALNKKWVW

SEQ ID NO: 1400126 - protein, 9 aa, Homo Sapiens
WGLAAQEVM

SEQ ID NO: 1400127 - protein, 9 aa, Homo Sapiens
WLSFSLPIN

SEQ ID NO: 1400128 - protein, 9 aa, Homo Sapiens
PDKVLHNIV

SEQ ID NO: 1400129 - protein, 9 aa, Homo Sapiens
TEHKVMHSK

SEQ ID NO: 1400130 - protein, 9 aa, Homo Sapiens
LNKLPNQVK

SEQ ID NO: 1400131 - protein, 9 aa, Homo Sapiens
SRGTVRTQR

SEQ ID NO: 1400132 - protein, 9 aa, Homo Sapiens
QNIKIQKSQ

SEQ ID NO: 1400133 - protein, 9 aa, Homo Sapiens
HADFTSLSD

SEQ ID NO: 1400134 - protein, 9 aa, Homo Sapiens
PCLRHIITV

SEQ ID NO: 1400135 - protein, 9 aa, Homo Sapiens
YLEMTVSGA

SEQ ID NO: 1400136 - protein, 9 aa, Homo Sapiens
PTYNRTSGN

SEQ ID NO: 1400137 - protein, 9 aa, Homo Sapiens
CHFTSIKVV

SEQ ID NO: 1400138 - protein, 9 aa, Homo Sapiens
TEFYKEALR

SEQ ID NO: 1400139 - protein, 9 aa, Homo Sapiens
GVDGDGQGR

SEQ ID NO: 1400140 - protein, 9 aa, Homo Sapiens
YMLTARSWD

SEQ ID NO: 1400141 - protein, 9 aa, Homo Sapiens
LFEAARVLS

SEQ ID NO: 1400142 - protein, 9 aa, Homo Sapiens
SPWQVMASL

SEQ ID NO: 1400143 - protein, 9 aa, Homo Sapiens
LRSLAAWDA

SEQ ID NO: 1400144 - protein, 9 aa, Homo Sapiens
SNDCCPSSS

SEQ ID NO: 1400145 - protein, 9 aa, Homo Sapiens
TLPVGPPAP

SEQ ID NO: 1400146 - protein, 9 aa, Homo Sapiens
QLRRARHDP

SEQ ID NO: 1400147 - protein, 9 aa, Homo Sapiens
HAPQIDKEA

SEQ ID NO: 1400148 - protein, 9 aa, Homo Sapiens
GIRTMEDPG

SEQ ID NO: 1400149 - protein, 9 aa, Homo Sapiens
VLHANSGPS

SEQ ID NO: 1400150 - protein, 9 aa, Homo Sapiens
PISGVALGA

SEQ ID NO: 1400151 - protein, 9 aa, Homo Sapiens
CIELDCWDS

SEQ ID NO: 1400152 - protein, 9 aa, Homo Sapiens
QHCLIEGKE

SEQ ID NO: 1400153 - protein, 9 aa, Homo Sapiens
EQLNGTQQV

SEQ ID NO: 1400154 - protein, 9 aa, Homo Sapiens
ILPNPRKSV

SEQ ID NO: 1400155 - protein, 9 aa, Homo Sapiens
NFRFQPQVN

SEQ ID NO: 1400156 - protein, 9 aa, Homo Sapiens
ESSLTWRVT

SEQ ID NO: 1400157 - protein, 9 aa, Homo Sapiens
MKCLTAVDC

SEQ ID NO: 1400158 - protein, 9 aa, Homo Sapiens
IGHISESPS

SEQ ID NO: 1400159 - protein, 9 aa, Homo Sapiens
HDQLRKKVL

SEQ ID NO: 1400160 - protein, 9 aa, Homo Sapiens
IIYSIPPAF

SEQ ID NO: 1400161 - protein, 9 aa, Homo Sapiens
PKALVKVKQ

SEQ ID NO: 1400162 - protein, 9 aa, Homo Sapiens
SGGGDRPHI

SEQ ID NO: 1400163 - protein, 9 aa, Homo Sapiens
VVPSTYLLD

SEQ ID NO: 1400164 - protein, 9 aa, Homo Sapiens
LLCSIIGGT

SEQ ID NO: 1400165 - protein, 9 aa, Homo Sapiens
LHKYYENCE

SEQ ID NO: 1400166 - protein, 9 aa, Homo Sapiens
RSSMYRGLW

SEQ ID NO: 1400167 - protein, 9 aa, Homo Sapiens
WCLLQGLWR

SEQ ID NO: 1400168 - protein, 9 aa, Homo Sapiens
QPQVNPVVP

SEQ ID NO: 1400169 - protein, 9 aa, Homo Sapiens
EAGRRANTS

SEQ ID NO: 1400170 - protein, 9 aa, Homo Sapiens
DAAAAVAWA

SEQ ID NO: 1400171 - protein, 9 aa, Homo Sapiens
DEGVMCLNG

SEQ ID NO: 1400172 - protein, 9 aa, Homo Sapiens
SSKCHNKQV

SEQ ID NO: 1400173 - protein, 9 aa, Homo Sapiens
KFCRTTENS

SEQ ID NO: 1400174 - protein, 9 aa, Homo Sapiens
PSYLEMTVS

SEQ ID NO: 1400175 - protein, 9 aa, Homo Sapiens
VAGQAGNEA

SEQ ID NO: 1400176 - protein, 9 aa, Homo Sapiens
SDNKKETEK

SEQ ID NO: 1400177 - protein, 9 aa, Homo Sapiens
EKGTVGVSG

SEQ ID NO: 1400178 - protein, 9 aa, Homo Sapiens
ACASHSGIS

SEQ ID NO: 1400179 - protein, 9 aa, Homo Sapiens
EVYGIQIYM

SEQ ID NO: 1400180 - protein, 9 aa, Homo Sapiens
PNMDTGENP

SEQ ID NO: 1400181 - protein, 9 aa, Homo Sapiens
LRPTTEHLY

SEQ ID NO: 1400182 - protein, 9 aa, Homo Sapiens
ACSVCPRSR

SEQ ID NO: 1400183 - protein, 9 aa, Homo Sapiens
CHHITGECS

SEQ ID NO: 1400184 - protein, 9 aa, Homo Sapiens
PQGLKMSAT

SEQ ID NO: 1400185 - protein, 9 aa, Homo Sapiens
GGTPDIHSS

SEQ ID NO: 1400186 - protein, 9 aa, Homo Sapiens
VVTGYVKIH

SEQ ID NO: 1400187 - protein, 9 aa, Homo Sapiens
PVLEMMPAA

SEQ ID NO: 1400188 - protein, 9 aa, Homo Sapiens
TLKKPLIES

SEQ ID NO: 1400189 - protein, 9 aa, Homo Sapiens
WSIVHKYMQ

SEQ ID NO: 1400190 - protein, 9 aa, Homo Sapiens
KHHVLKMMF

SEQ ID NO: 1400191 - protein, 9 aa, Homo Sapiens
RCFGYLTNQ

SEQ ID NO: 1400192 - protein, 9 aa, Homo Sapiens
NEKKQTEGG

SEQ ID NO: 1400193 - protein, 9 aa, Homo Sapiens
PCRRKKKVR

SEQ ID NO: 1400194 - protein, 9 aa, Homo Sapiens
MVIASRSLP

SEQ ID NO: 1400195 - protein, 9 aa, Homo Sapiens
RDYNMDFLT

SEQ ID NO: 1400196 - protein, 9 aa, Homo Sapiens
NRGVLRSLA

SEQ ID NO: 1400197 - protein, 9 aa, Homo Sapiens
KMIRRQTVT

SEQ ID NO: 1400198 - protein, 9 aa, Homo Sapiens
GKSDSSIIC

SEQ ID NO: 1400199 - protein, 9 aa, Homo Sapiens
FFPFFFILV

SEQ ID NO: 1400200 - protein, 9 aa, Homo Sapiens
PFQCIVCGK

SEQ ID NO: 1400201 - protein, 9 aa, Homo Sapiens
LVCGRHSSS

SEQ ID NO: 1400202 - protein, 9 aa, Homo Sapiens
VMNELWSKQ

SEQ ID NO: 1400203 - protein, 9 aa, Homo Sapiens
LQDGITAGK

SEQ ID NO: 1400204 - protein, 9 aa, Homo Sapiens
HFGNMANNF

SEQ ID NO: 1400205 - protein, 9 aa, Homo Sapiens
SVPVCCGDS

SEQ ID NO: 1400206 - protein, 9 aa, Homo Sapiens
TKPLPTNQP

SEQ ID NO: 1400207 - protein, 9 aa, Homo Sapiens
PRYVRDIKI

SEQ ID NO: 1400208 - protein, 9 aa, Homo Sapiens
HPSGRLEIY

SEQ ID NO: 1400209 - protein, 9 aa, Homo Sapiens
MLVALDRYV

SEQ ID NO: 1400210 - protein, 9 aa, Homo Sapiens
NEPTTGMLA

SEQ ID NO: 1400211 - protein, 9 aa, Homo Sapiens
VKQPPLLLE

SEQ ID NO: 1400212 - protein, 9 aa, Homo Sapiens
RSWKLLNYQ

SEQ ID NO: 1400213 - protein, 9 aa, Homo Sapiens
EYKKTYMEM

SEQ ID NO: 1400214 - protein, 9 aa, Homo Sapiens
TNQPLGKNQ

SEQ ID NO: 1400215 - protein, 9 aa, Homo Sapiens
RVDQPLHSG

SEQ ID NO: 1400216 - protein, 9 aa, Homo Sapiens
LDQPQQWLQ

SEQ ID NO: 1400217 - protein, 9 aa, Homo Sapiens
GQQRSFWKR

SEQ ID NO: 1400218 - protein, 9 aa, Homo Sapiens
LLTLPLLQQ

SEQ ID NO: 1400219 - protein, 9 aa, Homo Sapiens
PSTPSCGTT

SEQ ID NO: 1400220 - protein, 9 aa, Homo Sapiens
IFYSLICMY

SEQ ID NO: 1400221 - protein, 9 aa, Homo Sapiens
DIEAASSHR

SEQ ID NO: 1400222 - protein, 9 aa, Homo Sapiens
LIIRAKFVG

SEQ ID NO: 1400223 - protein, 9 aa, Homo Sapiens
GPSCLKQDP

SEQ ID NO: 1400224 - protein, 9 aa, Homo Sapiens
DGTHCGPYE

SEQ ID NO: 1400225 - protein, 9 aa, Homo Sapiens
FMTHQEAAT

SEQ ID NO: 1400226 - protein, 9 aa, Homo Sapiens
LSWFPENGL

SEQ ID NO: 1400227 - protein, 9 aa, Homo Sapiens
SSSKCHNKQ

SEQ ID NO: 1400228 - protein, 9 aa, Homo Sapiens
KADVNCACA

SEQ ID NO: 1400229 - protein, 9 aa, Homo Sapiens
KPRSESMWR

SEQ ID NO: 1400230 - protein, 9 aa, Homo Sapiens
AAQKCHKKT

SEQ ID NO: 1400231 - protein, 9 aa, Homo Sapiens
GGWTNNQHC

SEQ ID NO: 1400232 - protein, 9 aa, Homo Sapiens
MTAIQSHKL

SEQ ID NO: 1400233 - protein, 9 aa, Homo Sapiens
LNIITPPPH

SEQ ID NO: 1400234 - protein, 9 aa, Homo Sapiens
CGPDPKYPQ

SEQ ID NO: 1400235 - protein, 9 aa, Homo Sapiens
NMANNFTQD

SEQ ID NO: 1400236 - protein, 9 aa, Homo Sapiens
DLEVNVEAL

SEQ ID NO: 1400237 - protein, 9 aa, Homo Sapiens
ITQQKSNTV

SEQ ID NO: 1400238 - protein, 9 aa, Homo Sapiens
CRTTENSRT

SEQ ID NO: 1400239 - protein, 9 aa, Homo Sapiens
EDGSGKGRR

SEQ ID NO: 1400240 - protein, 9 aa, Homo Sapiens
LEHLRPSWC

SEQ ID NO: 1400241 - protein, 9 aa, Homo Sapiens
KYYLSIFMG

SEQ ID NO: 1400242 - protein, 9 aa, Homo Sapiens
REGGWTNNQ

SEQ ID NO: 1400243 - protein, 9 aa, Homo Sapiens
EAEQEMVCM

SEQ ID NO: 1400244 - protein, 9 aa, Homo Sapiens
FQPQVNPVV

SEQ ID NO: 1400245 - protein, 9 aa, Homo Sapiens
SGSFLSSWR

SEQ ID NO: 1400246 - protein, 9 aa, Homo Sapiens
LVGGEITDD

SEQ ID NO: 1400247 - protein, 9 aa, Homo Sapiens
TGDIVTVVA

SEQ ID NO: 1400248 - protein, 9 aa, Homo Sapiens
HITGECSCP

SEQ ID NO: 1400249 - protein, 9 aa, Homo Sapiens
EGLGPDPPT

SEQ ID NO: 1400250 - protein, 9 aa, Homo Sapiens
GPSWGPSTP

SEQ ID NO: 1400251 - protein, 9 aa, Homo Sapiens
REAQARVVR

SEQ ID NO: 1400252 - protein, 9 aa, Homo Sapiens
GWTNNQHCL

SEQ ID NO: 1400253 - protein, 9 aa, Homo Sapiens
DIKIQIEME

SEQ ID NO: 1400254 - protein, 9 aa, Homo Sapiens
DDGRVDQPL

SEQ ID NO: 1400255 - protein, 9 aa, Homo Sapiens
VACPDDQGG

SEQ ID NO: 1400256 - protein, 9 aa, Homo Sapiens
QPLGKNQDL

SEQ ID NO: 1400257 - protein, 9 aa, Homo Sapiens
WFEHMNSVP

SEQ ID NO: 1400258 - protein, 9 aa, Homo Sapiens
CIAELRFLC

SEQ ID NO: 1400259 - protein, 9 aa, Homo Sapiens
SKGNLERLH

SEQ ID NO: 1400260 - protein, 9 aa, Homo Sapiens
PVLSHRSLY

SEQ ID NO: 1400261 - protein, 9 aa, Homo Sapiens
IPHGPPMCG

SEQ ID NO: 1400262 - protein, 9 aa, Homo Sapiens
VAKKTIQCQ

SEQ ID NO: 1400263 - protein, 9 aa, Homo Sapiens
LFLIVHVSF

SEQ ID NO: 1400264 - protein, 9 aa, Homo Sapiens
FPQCTFFFL

SEQ ID NO: 1400265 - protein, 9 aa, Homo Sapiens
FSLAKTWCR

SEQ ID NO: 1400266 - protein, 9 aa, Homo Sapiens
EVLIEDLEL

SEQ ID NO: 1400267 - protein, 9 aa, Homo Sapiens
EYEDGSSIP

SEQ ID NO: 1400268 - protein, 9 aa, Homo Sapiens
HMFEFFDRT

SEQ ID NO: 1400269 - protein, 9 aa, Homo Sapiens
VILPNPRKS

SEQ ID NO: 1400270 - protein, 9 aa, Homo Sapiens
SLWESLEIP

SEQ ID NO: 1400271 - protein, 9 aa, Homo Sapiens
LCWCKMPHP

SEQ ID NO: 1400272 - protein, 9 aa, Homo Sapiens
AVMALNRYV

SEQ ID NO: 1400273 - protein, 9 aa, Homo Sapiens
KNQDLTSLW

SEQ ID NO: 1400274 - protein, 9 aa, Homo Sapiens
FATCYLLCV

SEQ ID NO: 1400275 - protein, 9 aa, Homo Sapiens
DMKQVYNFI

SEQ ID NO: 1400276 - protein, 9 aa, Homo Sapiens
SSQQQAPLQ

SEQ ID NO: 1400277 - protein, 9 aa, Homo Sapiens
GKTKTVKDL

SEQ ID NO: 1400278 - protein, 9 aa, Homo Sapiens
QKKFMGTEL

SEQ ID NO: 1400279 - protein, 9 aa, Homo Sapiens
ISQHASGNT

SEQ ID NO: 1400280 - protein, 9 aa, Homo Sapiens
LEKKQDPKG

SEQ ID NO: 1400281 - protein, 9 aa, Homo Sapiens
LIIEDSLWT

SEQ ID NO: 1400282 - protein, 9 aa, Homo Sapiens
SLHRYLSLC

SEQ ID NO: 1400283 - protein, 9 aa, Homo Sapiens
AMYTTCIIW

SEQ ID NO: 1400284 - protein, 9 aa, Homo Sapiens
VVEVHDQDR

SEQ ID NO: 1400285 - protein, 9 aa, Homo Sapiens
RYFLVKRPS

SEQ ID NO: 1400286 - protein, 9 aa, Homo Sapiens
PVCSVPVCC

SEQ ID NO: 1400287 - protein, 9 aa, Homo Sapiens
EGVMCLNGN

SEQ ID NO: 1400288 - protein, 9 aa, Homo Sapiens
VYHGQGIQY

SEQ ID NO: 1400289 - protein, 9 aa, Homo Sapiens
GDWEVQRTM

SEQ ID NO: 1400290 - protein, 9 aa, Homo Sapiens
NLKDTTTKR

SEQ ID NO: 1400291 - protein, 9 aa, Homo Sapiens
ALGHLHSIK

SEQ ID NO: 1400292 - protein, 9 aa, Homo Sapiens
LHGVDGDGQ

SEQ ID NO: 1400293 - protein, 9 aa, Homo Sapiens
SEDAVGEPR

SEQ ID NO: 1400294 - protein, 9 aa, Homo Sapiens
EPRWARLPQ

SEQ ID NO: 1400295 - protein, 9 aa, Homo Sapiens
PNTYLPDSC

SEQ ID NO: 1400296 - protein, 9 aa, Homo Sapiens
DLELQINGF

SEQ ID NO: 1400297 - protein, 9 aa, Homo Sapiens
EFSTLPVGP

SEQ ID NO: 1400298 - protein, 9 aa, Homo Sapiens
ARHDPPDLA

SEQ ID NO: 1400299 - protein, 9 aa, Homo Sapiens
PLLHLVAEV

SEQ ID NO: 1400300 - protein, 9 aa, Homo Sapiens
KELYEWDNR

SEQ ID NO: 1400301 - protein, 9 aa, Homo Sapiens
FEHMNSVPQ

SEQ ID NO: 1400302 - protein, 9 aa, Homo Sapiens
GSFLSSWRC

SEQ ID NO: 1400303 - protein, 9 aa, Homo Sapiens
TQTEKEDNS

SEQ ID NO: 1400304 - protein, 9 aa, Homo Sapiens
QFKQLAYLW

SEQ ID NO: 1400305 - protein, 9 aa, Homo Sapiens
QQDRMVERI

SEQ ID NO: 1400306 - protein, 9 aa, Homo Sapiens
ANSNPPVWY

SEQ ID NO: 1400307 - protein, 9 aa, Homo Sapiens
EFVMCRRMV

SEQ ID NO: 1400308 - protein, 9 aa, Homo Sapiens
LRPSWCPPG

SEQ ID NO: 1400309 - protein, 9 aa, Homo Sapiens
TYMEMHYGH

SEQ ID NO: 1400310 - protein, 9 aa, Homo Sapiens
TCYLLCVRR

SEQ ID NO: 1400311 - protein, 9 aa, Homo Sapiens
FVEFSTLPV

SEQ ID NO: 1400312 - protein, 9 aa, Homo Sapiens
AKKTIQCQS

SEQ ID NO: 1400313 - protein, 9 aa, Homo Sapiens
FLVGCVPFL

SEQ ID NO: 1400314 - protein, 9 aa, Homo Sapiens
LHILDVKDV

SEQ ID NO: 1400315 - protein, 9 aa, Homo Sapiens
SGTILAYCS

SEQ ID NO: 1400316 - protein, 9 aa, Homo Sapiens
FLSSWRCFS

SEQ ID NO: 1400317 - protein, 9 aa, Homo Sapiens
MALAAIAVH

SEQ ID NO: 1400318 - protein, 9 aa, Homo Sapiens
AIHAKYDVI

SEQ ID NO: 1400319 - protein, 9 aa, Homo Sapiens
SESVLRDSL

SEQ ID NO: 1400320 - protein, 9 aa, Homo Sapiens
EEQENTEEE

SEQ ID NO: 1400321 - protein, 9 aa, Homo Sapiens
FHPSGRLEI

SEQ ID NO: 1400322 - protein, 9 aa, Homo Sapiens
HVPRVVHIT

SEQ ID NO: 1400323 - protein, 9 aa, Homo Sapiens
TPTGRGRAA

SEQ ID NO: 1400324 - protein, 9 aa, Homo Sapiens
VCSVPVCCG

SEQ ID NO: 1400325 - protein, 9 aa, Homo Sapiens
SSMYRGLWL

SEQ ID NO: 1400326 - protein, 9 aa, Homo Sapiens
GQLKSGDAA

SEQ ID NO: 1400327 - protein, 9 aa, Homo Sapiens
PCPPPVTPL

SEQ ID NO: 1400328 - protein, 9 aa, Homo Sapiens
EFPLSGGAG

SEQ ID NO: 1400329 - protein, 9 aa, Homo Sapiens
IKVVKKASG

SEQ ID NO: 1400330 - protein, 9 aa, Homo Sapiens
NNLKNCIYP

SEQ ID NO: 1400331 - protein, 9 aa, Homo Sapiens
PPAPAPWLP

SEQ ID NO: 1400332 - protein, 9 aa, Homo Sapiens
GWASHRDVP

SEQ ID NO: 1400333 - protein, 9 aa, Homo Sapiens
FNLLGCLWS

SEQ ID NO: 1400334 - protein, 9 aa, Homo Sapiens
LCNQYEEKV

SEQ ID NO: 1400335 - protein, 9 aa, Homo Sapiens
AVLGTMVMK

SEQ ID NO: 1400336 - protein, 9 aa, Homo Sapiens
CPRSRTASA

SEQ ID NO: 1400337 - protein, 9 aa, Homo Sapiens
APLQSVPPS

SEQ ID NO: 1400338 - protein, 9 aa, Homo Sapiens
GQTGNSKYS

SEQ ID NO: 1400339 - protein, 9 aa, Homo Sapiens
PLPTNQPLG

SEQ ID NO: 1400340 - protein, 9 aa, Homo Sapiens
LVKRPSLHR

SEQ ID NO: 1400341 - protein, 9 aa, Homo Sapiens
GRHYDHNHQ

SEQ ID NO: 1400342 - protein, 9 aa, Homo Sapiens
VLKDWAEVY

SEQ ID NO: 1400343 - protein, 9 aa, Homo Sapiens
VEGHVQLSR

SEQ ID NO: 1400344 - protein, 9 aa, Homo Sapiens
HCAGREPQL

SEQ ID NO: 1400345 - protein, 9 aa, Homo Sapiens
VGEFPVLFL

SEQ ID NO: 1400346 - protein, 9 aa, Homo Sapiens
YNNQINRNN

SEQ ID NO: 1400347 - protein, 9 aa, Homo Sapiens
RRLHALEKS

SEQ ID NO: 1400348 - protein, 9 aa, Homo Sapiens
SPSTKSCGA

SEQ ID NO: 1400349 - protein, 9 aa, Homo Sapiens
QATTSTEAS

SEQ ID NO: 1400350 - protein, 9 aa, Homo Sapiens
PEELTNTLE

SEQ ID NO: 1400351 - protein, 9 aa, Homo Sapiens
GMDIILGVF

SEQ ID NO: 1400352 - protein, 9 aa, Homo Sapiens
SVAENNLCN

SEQ ID NO: 1400353 - protein, 9 aa, Homo Sapiens
GVHKIIYTM

SEQ ID NO: 1400354 - protein, 9 aa, Homo Sapiens
CCICGAIVR

SEQ ID NO: 1400355 - protein, 9 aa, Homo Sapiens
FFFSGWISG

SEQ ID NO: 1400356 - protein, 9 aa, Homo Sapiens
QPPHLPGSD

SEQ ID NO: 1400357 - protein, 9 aa, Homo Sapiens
KLLLFLRLD

SEQ ID NO: 1400358 - protein, 9 aa, Homo Sapiens
RTNSGGGDR

SEQ ID NO: 1400359 - protein, 9 aa, Homo Sapiens
GSTIEASDQ

SEQ ID NO: 1400360 - protein, 9 aa, Homo Sapiens
GYVKIHHSH

SEQ ID NO: 1400361 - protein, 9 aa, Homo Sapiens
GPVGRQNHK

SEQ ID NO: 1400362 - protein, 9 aa, Homo Sapiens
HIGPVGRQN

SEQ ID NO: 1400363 - protein, 9 aa, Homo Sapiens
HDPPDLAPN

SEQ ID NO: 1400364 - protein, 9 aa, Homo Sapiens
GVHAAPSAQ

SEQ ID NO: 1400365 - protein, 9 aa, Homo Sapiens
FDAHGPKYW

SEQ ID NO: 1400366 - protein, 9 aa, Homo Sapiens
LPPHEDYED

SEQ ID NO: 1400367 - protein, 9 aa, Homo Sapiens
GSCVVLKSS

SEQ ID NO: 1400368 - protein, 9 aa, Homo Sapiens
IGLSAETTE

SEQ ID NO: 1400369 - protein, 9 aa, Homo Sapiens
AEYELEKHV

SEQ ID NO: 1400370 - protein, 9 aa, Homo Sapiens
QNIGAGRPI

SEQ ID NO: 1400371 - protein, 9 aa, Homo Sapiens
SRTASASRP

SEQ ID NO: 1400372 - protein, 9 aa, Homo Sapiens
NSGMDIILG

SEQ ID NO: 1400373 - protein, 9 aa, Homo Sapiens
SHDTVTFRT

SEQ ID NO: 1400374 - protein, 9 aa, Homo Sapiens
VAQVYFFHF

SEQ ID NO: 1400375 - protein, 9 aa, Homo Sapiens
LDRVAALRW

SEQ ID NO: 1400376 - protein, 9 aa, Homo Sapiens
CGVYTGNMA

SEQ ID NO: 1400377 - protein, 9 aa, Homo Sapiens
VFYCGMAAV

SEQ ID NO: 1400378 - protein, 9 aa, Homo Sapiens
DTLVLAQEG

SEQ ID NO: 1400379 - protein, 9 aa, Homo Sapiens
SLSGRLAWV

SEQ ID NO: 1400380 - protein, 9 aa, Homo Sapiens
PGRSPQQLK

SEQ ID NO: 1400381 - protein, 9 aa, Homo Sapiens
VLGRHCFEA

SEQ ID NO: 1400382 - protein, 9 aa, Homo Sapiens
RDTGPGKQK

SEQ ID NO: 1400383 - protein, 9 aa, Homo Sapiens
TLRMTKPEP

SEQ ID NO: 1400384 - protein, 9 aa, Homo Sapiens
SSSALSCAS

SEQ ID NO: 1400385 - protein, 9 aa, Homo Sapiens
HRDVPGSKR

SEQ ID NO: 1400386 - protein, 9 aa, Homo Sapiens
NRTSGNSWQ

SEQ ID NO: 1400387 - protein, 9 aa, Homo Sapiens
GMAAVPIVI

SEQ ID NO: 1400388 - protein, 9 aa, Homo Sapiens
VAWAAAPTP

SEQ ID NO: 1400389 - protein, 9 aa, Homo Sapiens
GLTRCQAVV

SEQ ID NO: 1400390 - protein, 9 aa, Homo Sapiens
DTVTFRTAR

SEQ ID NO: 1400391 - protein, 9 aa, Homo Sapiens
NTEEEEEAE

SEQ ID NO: 1400392 - protein, 9 aa, Homo Sapiens
RVAALRWVQ

SEQ ID NO: 1400393 - protein, 9 aa, Homo Sapiens
NCACASHSG

SEQ ID NO: 1400394 - protein, 9 aa, Homo Sapiens
LEELEKMGN

SEQ ID NO: 1400395 - protein, 9 aa, Homo Sapiens
IGLETIGVK

SEQ ID NO: 1400396 - protein, 9 aa, Homo Sapiens
SLNHSLHIT

SEQ ID NO: 1400397 - protein, 9 aa, Homo Sapiens
AAGAEREHH

SEQ ID NO: 1400398 - protein, 9 aa, Homo Sapiens
NLEEDIGQS

SEQ ID NO: 1400399 - protein, 9 aa, Homo Sapiens
IASALGHLH

SEQ ID NO: 1400400 - protein, 9 aa, Homo Sapiens
YGIQIYMLD

SEQ ID NO: 1400401 - protein, 9 aa, Homo Sapiens
TRILGRVSA

SEQ ID NO: 1400402 - protein, 9 aa, Homo Sapiens
RTTENSRTQ

SEQ ID NO: 1400403 - protein, 9 aa, Homo Sapiens
WATSTAAST

SEQ ID NO: 1400404 - protein, 9 aa, Homo Sapiens
NNEDCLCTA

SEQ ID NO: 1400405 - protein, 9 aa, Homo Sapiens
ELGIKELYE

SEQ ID NO: 1400406 - protein, 9 aa, Homo Sapiens
ASILFLIVH

SEQ ID NO: 1400407 - protein, 9 aa, Homo Sapiens
LWSWCGTSQ

SEQ ID NO: 1400408 - protein, 9 aa, Homo Sapiens
KYDVIDKDT

SEQ ID NO: 1400409 - protein, 9 aa, Homo Sapiens
HRFGKHVPR

SEQ ID NO: 1400410 - protein, 9 aa, Homo Sapiens
KQDPKGKGH

SEQ ID NO: 1400411 - protein, 9 aa, Homo Sapiens
LIRVENEDP

SEQ ID NO: 1400412 - protein, 9 aa, Homo Sapiens
LRGMMSEID

SEQ ID NO: 1400413 - protein, 9 aa, Homo Sapiens
PCPLLEGSA

SEQ ID NO: 1400414 - protein, 9 aa, Homo Sapiens
RGAPALSWF

SEQ ID NO: 1400415 - protein, 9 aa, Homo Sapiens
SLEIPLLFT

SEQ ID NO: 1400416 - protein, 9 aa, Homo Sapiens
GADGVGKSA

SEQ ID NO: 1400417 - protein, 9 aa, Homo Sapiens
RYLSLCIRA

SEQ ID NO: 1400418 - protein, 9 aa, Homo Sapiens
NRYVAICDP

SEQ ID NO: 1400419 - protein, 9 aa, Homo Sapiens
RPISGVALG

SEQ ID NO: 1400420 - protein, 9 aa, Homo Sapiens
VAPVHETCA

SEQ ID NO: 1400421 - protein, 9 aa, Homo Sapiens
LVVLPIQFK

SEQ ID NO: 1400422 - protein, 9 aa, Homo Sapiens
AMRYNNQIN

SEQ ID NO: 1400423 - protein, 9 aa, Homo Sapiens
RPRPTKNTR

SEQ ID NO: 1400424 - protein, 9 aa, Homo Sapiens
RSFWKRKST

SEQ ID NO: 1400425 - protein, 9 aa, Homo Sapiens
DPFHSWRKL

SEQ ID NO: 1400426 - protein, 9 aa, Homo Sapiens
ISGVALGAF

SEQ ID NO: 1400427 - protein, 9 aa, Homo Sapiens
WGESPWQVM

SEQ ID NO: 1400428 - protein, 9 aa, Homo Sapiens
KLPPAPAPW

SEQ ID NO: 1400429 - protein, 9 aa, Homo Sapiens
GRLEIYRNK

SEQ ID NO: 1400430 - protein, 9 aa, Homo Sapiens
APESVLHAN

SEQ ID NO: 1400431 - protein, 9 aa, Homo Sapiens
KKVWSFMTH

SEQ ID NO: 1400432 - protein, 9 aa, Homo Sapiens
ARTRWTTAA

SEQ ID NO: 1400433 - protein, 9 aa, Homo Sapiens
PLGKNQDLT

SEQ ID NO: 1400434 - protein, 9 aa, Homo Sapiens
VMHSKSLDT

SEQ ID NO: 1400435 - protein, 9 aa, Homo Sapiens
GDVRADGER

SEQ ID NO: 1400436 - protein, 9 aa, Homo Sapiens
QPPQKFAAS

SEQ ID NO: 1400437 - protein, 9 aa, Homo Sapiens
IPPAFRDRN

SEQ ID NO: 1400438 - protein, 9 aa, Homo Sapiens
RAGASASRH

SEQ ID NO: 1400439 - protein, 9 aa, Homo Sapiens
AAAAAADAA

SEQ ID NO: 1400440 - protein, 9 aa, Homo Sapiens
EDLELQING

SEQ ID NO: 1400441 - protein, 9 aa, Homo Sapiens
RPIISPNLT

SEQ ID NO: 1400442 - protein, 9 aa, Homo Sapiens
LDEFLMGGM

SEQ ID NO: 1400443 - protein, 9 aa, Homo Sapiens
RWVVFCQLC

SEQ ID NO: 1400444 - protein, 9 aa, Homo Sapiens
SFLSSWRCF

SEQ ID NO: 1400445 - protein, 9 aa, Homo Sapiens
EATTSPGLL

SEQ ID NO: 1400446 - protein, 9 aa, Homo Sapiens
ILVPRLECS

SEQ ID NO: 1400447 - protein, 9 aa, Homo Sapiens
FLMGGMSRT

SEQ ID NO: 1400448 - protein, 9 aa, Homo Sapiens
NQEVARWVV

SEQ ID NO: 1400449 - protein, 9 aa, Homo Sapiens
ERDCRDNRE

SEQ ID NO: 1400450 - protein, 9 aa, Homo Sapiens
GRNYYGNSL

SEQ ID NO: 1400451 - protein, 9 aa, Homo Sapiens
QDIEAASSH

SEQ ID NO: 1400452 - protein, 9 aa, Homo Sapiens
ANNLLCQLW

SEQ ID NO: 1400453 - protein, 9 aa, Homo Sapiens
SLPVAFFFS

SEQ ID NO: 1400454 - protein, 9 aa, Homo Sapiens
GSSIPLAGE

SEQ ID NO: 1400455 - protein, 9 aa, Homo Sapiens
DLRITQQKS

SEQ ID NO: 1400456 - protein, 9 aa, Homo Sapiens
SSHLPTLAS

SEQ ID NO: 1400457 - protein, 9 aa, Homo Sapiens
FPWMVTRIN

SEQ ID NO: 1400458 - protein, 9 aa, Homo Sapiens
RIGGGTPLS

SEQ ID NO: 1400459 - protein, 9 aa, Homo Sapiens
PYFQQTGVH

SEQ ID NO: 1400460 - protein, 9 aa, Homo Sapiens
AADAAAAVA

SEQ ID NO: 1400461 - protein, 9 aa, Homo Sapiens
CKYCSKVLG

SEQ ID NO: 1400462 - protein, 9 aa, Homo Sapiens
QSAEAGRRA

SEQ ID NO: 1400463 - protein, 9 aa, Homo Sapiens
FFLLFTWQV

SEQ ID NO: 1400464 - protein, 9 aa, Homo Sapiens
IQCQSSFNI

SEQ ID NO: 1400465 - protein, 9 aa, Homo Sapiens
LIIFKGARY

SEQ ID NO: 1400466 - protein, 9 aa, Homo Sapiens
CPPGMAQRP

SEQ ID NO: 1400467 - protein, 9 aa, Homo Sapiens
TLLIRVENE

SEQ ID NO: 1400468 - protein, 9 aa, Homo Sapiens
ELTCQIAHI

SEQ ID NO: 1400469 - protein, 9 aa, Homo Sapiens
ESGVLMLVA

SEQ ID NO: 1400470 - protein, 9 aa, Homo Sapiens
HRWGHWMDW

SEQ ID NO: 1400471 - protein, 9 aa, Homo Sapiens
RCALWIPEV

SEQ ID NO: 1400472 - protein, 9 aa, Homo Sapiens
VSAQPAARA

SEQ ID NO: 1400473 - protein, 9 aa, Homo Sapiens
SIKVVKKAS

SEQ ID NO: 1400474 - protein, 9 aa, Homo Sapiens
PGKQKREDE

SEQ ID NO: 1400475 - protein, 9 aa, Homo Sapiens
KTYMEMHYG

SEQ ID NO: 1400476 - protein, 9 aa, Homo Sapiens
ADGVGKSAL

SEQ ID NO: 1400477 - protein, 9 aa, Homo Sapiens
YEDGSSIPL

SEQ ID NO: 1400478 - protein, 9 aa, Homo Sapiens
SAGDDCERV

SEQ ID NO: 1400479 - protein, 9 aa, Homo Sapiens
ASRVDVMKL

SEQ ID NO: 1400480 - protein, 9 aa, Homo Sapiens
EKHNADYDL

SEQ ID NO: 1400481 - protein, 9 aa, Homo Sapiens
LTLNAGGQQ

SEQ ID NO: 1400482 - protein, 9 aa, Homo Sapiens
CLAQLSEEK

SEQ ID NO: 1400483 - protein, 9 aa, Homo Sapiens
KWVHVRCAL

SEQ ID NO: 1400484 - protein, 9 aa, Homo Sapiens
PQVAMLPKL

SEQ ID NO: 1400485 - protein, 9 aa, Homo Sapiens
HLPTLASRV

SEQ ID NO: 1400486 - protein, 9 aa, Homo Sapiens
QRPDGEGCV

SEQ ID NO: 1400487 - protein, 9 aa, Homo Sapiens
DYEKATEFY

SEQ ID NO: 1400488 - protein, 9 aa, Homo Sapiens
RITNSCKNP

SEQ ID NO: 1400489 - protein, 9 aa, Homo Sapiens
KKTEGVKEA

SEQ ID NO: 1400490 - protein, 9 aa, Homo Sapiens
MVVEVHDQD

SEQ ID NO: 1400491 - protein, 9 aa, Homo Sapiens
ASGKGSAKP

SEQ ID NO: 1400492 - protein, 9 aa, Homo Sapiens
SSIPLAGEE

SEQ ID NO: 1400493 - protein, 9 aa, Homo Sapiens
CLWSGPTSA

SEQ ID NO: 1400494 - protein, 9 aa, Homo Sapiens
KQSTKLAMS

SEQ ID NO: 1400495 - protein, 9 aa, Homo Sapiens
ISSNNSKPM

SEQ ID NO: 1400496 - protein, 9 aa, Homo Sapiens
YLGLHDNDS

SEQ ID NO: 1400497 - protein, 9 aa, Homo Sapiens
KKLEKKQDP

SEQ ID NO: 1400498 - protein, 9 aa, Homo Sapiens
QEGRFGLLA

SEQ ID NO: 1400499 - protein, 9 aa, Homo Sapiens
LTISPFSTV

SEQ ID NO: 1400500 - protein, 9 aa, Homo Sapiens
PWGLSPRKL

SEQ ID NO: 1400501 - protein, 9 aa, Homo Sapiens
ENLKDTTTK

SEQ ID NO: 1400502 - protein, 9 aa, Homo Sapiens
FHIGPVGRQ

SEQ ID NO: 1400503 - protein, 9 aa, Homo Sapiens
IAVMALNRY

SEQ ID NO: 1400504 - protein, 9 aa, Homo Sapiens
FKFFFQRNH

SEQ ID NO: 1400505 - protein, 9 aa, Homo Sapiens
MYLINVVTN

SEQ ID NO: 1400506 - protein, 9 aa, Homo Sapiens
IEAASSHRL

SEQ ID NO: 1400507 - protein, 9 aa, Homo Sapiens
REEDFIQPN

SEQ ID NO: 1400508 - protein, 9 aa, Homo Sapiens
QALEELEKM

SEQ ID NO: 1400509 - protein, 9 aa, Homo Sapiens
LDGTHCGPY

SEQ ID NO: 1400510 - protein, 9 aa, Homo Sapiens
KSNTVEDPF

SEQ ID NO: 1400511 - protein, 9 aa, Homo Sapiens
PLCPLKHHS

SEQ ID NO: 1400512 - protein, 9 aa, Homo Sapiens
DVRADGERQ

SEQ ID NO: 1400513 - protein, 9 aa, Homo Sapiens
PSCGTTTAC

SEQ ID NO: 1400514 - protein, 9 aa, Homo Sapiens
LGDVRADGE

SEQ ID NO: 1400515 - protein, 9 aa, Homo Sapiens
CGSFARGAE

SEQ ID NO: 1400516 - protein, 9 aa, Homo Sapiens
LQPSSLTAN

SEQ ID NO: 1400517 - protein, 9 aa, Homo Sapiens
FLDQPQQWL

SEQ ID NO: 1400518 - protein, 9 aa, Homo Sapiens
LKYGVHKII

SEQ ID NO: 1400519 - protein, 9 aa, Homo Sapiens
KPMEDKDAV

SEQ ID NO: 1400520 - protein, 9 aa, Homo Sapiens
AVASTLVWK

SEQ ID NO: 1400521 - protein, 9 aa, Homo Sapiens
LKKPLIESK

SEQ ID NO: 1400522 - protein, 9 aa, Homo Sapiens
TNSGGGDRP

SEQ ID NO: 1400523 - protein, 9 aa, Homo Sapiens
IDFGHMETV

SEQ ID NO: 1400524 - protein, 9 aa, Homo Sapiens
RSAGDDCER

SEQ ID NO: 1400525 - protein, 9 aa, Homo Sapiens
KITWQEFID

SEQ ID NO: 1400526 - protein, 9 aa, Homo Sapiens
AWRASHMMT

SEQ ID NO: 1400527 - protein, 9 aa, Homo Sapiens
SQNFALTKH

SEQ ID NO: 1400528 - protein, 9 aa, Homo Sapiens
NDNSSIMVR

SEQ ID NO: 1400529 - protein, 9 aa, Homo Sapiens
KATEFYKEA

SEQ ID NO: 1400530 - protein, 9 aa, Homo Sapiens
CQIWSIVHK

SEQ ID NO: 1400531 - protein, 9 aa, Homo Sapiens
PMEDKDAVA

SEQ ID NO: 1400532 - protein, 9 aa, Homo Sapiens
CFAQAHFDF

SEQ ID NO: 1400533 - protein, 9 aa, Homo Sapiens
NHLLYPRHC

SEQ ID NO: 1400534 - protein, 9 aa, Homo Sapiens
ASTAPTLST

SEQ ID NO: 1400535 - protein, 9 aa, Homo Sapiens
SGLVNQERT

SEQ ID NO: 1400536 - protein, 9 aa, Homo Sapiens
SNSNREVAL

SEQ ID NO: 1400537 - protein, 9 aa, Homo Sapiens
TELLNGIRT

SEQ ID NO: 1400538 - protein, 9 aa, Homo Sapiens
NHSLHITQH

SEQ ID NO: 1400539 - protein, 9 aa, Homo Sapiens
PTRREDKVH

SEQ ID NO: 1400540 - protein, 9 aa, Homo Sapiens
RAKLRWIRI

SEQ ID NO: 1400541 - protein, 9 aa, Homo Sapiens
SFETGTKNL

SEQ ID NO: 1400542 - protein, 9 aa, Homo Sapiens
SHVVVCDIN

SEQ ID NO: 1400543 - protein, 9 aa, Homo Sapiens
EDIGQSEQK

SEQ ID NO: 1400544 - protein, 9 aa, Homo Sapiens
RSLAAWDAP

SEQ ID NO: 1400545 - protein, 9 aa, Homo Sapiens
AQVTSTLLN

SEQ ID NO: 1400546 - protein, 9 aa, Homo Sapiens
VCAGPSWGP

SEQ ID NO: 1400547 - protein, 9 aa, Homo Sapiens
KKSTRPSGS

SEQ ID NO: 1400548 - protein, 9 aa, Homo Sapiens
GHVQLSRFA

SEQ ID NO: 1400549 - protein, 9 aa, Homo Sapiens
KQEGGNNEL

SEQ ID NO: 1400550 - protein, 9 aa, Homo Sapiens
YLTLNAGGQ

SEQ ID NO: 1400551 - protein, 9 aa, Homo Sapiens
VNATVVTMP

SEQ ID NO: 1400552 - protein, 9 aa, Homo Sapiens
VIAVMALNR

SEQ ID NO: 1400553 - protein, 9 aa, Homo Sapiens
TEAELRGMM

SEQ ID NO: 1400554 - protein, 9 aa, Homo Sapiens
LGWASHRDV

SEQ ID NO: 1400555 - protein, 9 aa, Homo Sapiens
MTLKKPLIE

SEQ ID NO: 1400556 - protein, 9 aa, Homo Sapiens
IPRYVRDIK

SEQ ID NO: 1400557 - protein, 9 aa, Homo Sapiens
ESDIIYKKL

SEQ ID NO: 1400558 - protein, 9 aa, Homo Sapiens
ISRPTSRAR

SEQ ID NO: 1400559 - protein, 9 aa, Homo Sapiens
ERGEAEWHK

SEQ ID NO: 1400560 - protein, 9 aa, Homo Sapiens
SRPTSRARQ

SEQ ID NO: 1400561 - protein, 9 aa, Homo Sapiens
VMKLLLFLR

SEQ ID NO: 1400562 - protein, 9 aa, Homo Sapiens
LPTECSLAI

SEQ ID NO: 1400563 - protein, 9 aa, Homo Sapiens
GALSLKKSS

SEQ ID NO: 1400564 - protein, 9 aa, Homo Sapiens
VCRESERDY

SEQ ID NO: 1400565 - protein, 9 aa, Homo Sapiens
PVHETCAQT

SEQ ID NO: 1400566 - protein, 9 aa, Homo Sapiens
PPQAAGAER

SEQ ID NO: 1400567 - protein, 9 aa, Homo Sapiens
LEIALTISP

SEQ ID NO: 1400568 - protein, 9 aa, Homo Sapiens
SGKGSAKPS

SEQ ID NO: 1400569 - protein, 9 aa, Homo Sapiens
PGEKKSQAS

SEQ ID NO: 1400570 - protein, 9 aa, Homo Sapiens
GGIATNVHP

SEQ ID NO: 1400571 - protein, 9 aa, Homo Sapiens
VSTGSLTNQ

SEQ ID NO: 1400572 - protein, 9 aa, Homo Sapiens
ILFLIVHVS

SEQ ID NO: 1400573 - protein, 9 aa, Homo Sapiens
KHVERLELF

SEQ ID NO: 1400574 - protein, 9 aa, Homo Sapiens
DALLCHALQ

SEQ ID NO: 1400575 - protein, 9 aa, Homo Sapiens
EEEPSKQRG

SEQ ID NO: 1400576 - protein, 9 aa, Homo Sapiens
APCPLLEGS

SEQ ID NO: 1400577 - protein, 9 aa, Homo Sapiens
NDKHIHGSP

SEQ ID NO: 1400578 - protein, 9 aa, Homo Sapiens
CICPPGMAQ

SEQ ID NO: 1400579 - protein, 9 aa, Homo Sapiens
SLHPCRLNK

SEQ ID NO: 1400580 - protein, 9 aa, Homo Sapiens
STNFLFLSN

SEQ ID NO: 1400581 - protein, 9 aa, Homo Sapiens
EELEKMGNF

SEQ ID NO: 1400582 - protein, 9 aa, Homo Sapiens
LTFMGQLLE

SEQ ID NO: 1400583 - protein, 9 aa, Homo Sapiens
QNIEQQKPN

SEQ ID NO: 1400584 - protein, 9 aa, Homo Sapiens
GQNLEEDIG

SEQ ID NO: 1400585 - protein, 9 aa, Homo Sapiens
QQTAAKAVQ

SEQ ID NO: 1400586 - protein, 9 aa, Homo Sapiens
SASRHAGKV

SEQ ID NO: 1400587 - protein, 9 aa, Homo Sapiens
KEKHNADYD

SEQ ID NO: 1400588 - protein, 9 aa, Homo Sapiens
GTSQTYFGS

SEQ ID NO: 1400589 - protein, 9 aa, Homo Sapiens
LTAVDCLQA

SEQ ID NO: 1400590 - protein, 9 aa, Homo Sapiens
ASALGHLHS

SEQ ID NO: 1400591 - protein, 9 aa, Homo Sapiens
LNTPQLADI

SEQ ID NO: 1400592 - protein, 9 aa, Homo Sapiens
LWESLEIPL

SEQ ID NO: 1400593 - protein, 9 aa, Homo Sapiens
LRWIRIIPD

SEQ ID NO: 1400594 - protein, 9 aa, Homo Sapiens
LGEPWRAGF

SEQ ID NO: 1400595 - protein, 9 aa, Homo Sapiens
KRTREEEEG

SEQ ID NO: 1400596 - protein, 9 aa, Homo Sapiens
GPWVRFPKD

SEQ ID NO: 1400597 - protein, 9 aa, Homo Sapiens
KFFFQRNHY

SEQ ID NO: 1400598 - protein, 9 aa, Homo Sapiens
MCGPDPKYP

SEQ ID NO: 1400599 - protein, 9 aa, Homo Sapiens
LDISFAIHQ

SEQ ID NO: 1400600 - protein, 9 aa, Homo Sapiens
GVFHIGPVG

SEQ ID NO: 1400601 - protein, 9 aa, Homo Sapiens
VLIGLHGVD

SEQ ID NO: 1400602 - protein, 9 aa, Homo Sapiens
QHFDTLRMT

SEQ ID NO: 1400603 - protein, 9 aa, Homo Sapiens
DRPGAFIKQ

SEQ ID NO: 1400604 - protein, 9 aa, Homo Sapiens
RRPENNYYF

SEQ ID NO: 1400605 - protein, 9 aa, Homo Sapiens
RVAGTAGAR

SEQ ID NO: 1400606 - protein, 9 aa, Homo Sapiens
HGVDGDGQG

SEQ ID NO: 1400607 - protein, 9 aa, Homo Sapiens
VIDKDTPIP

SEQ ID NO: 1400608 - protein, 9 aa, Homo Sapiens
QKKRQQDRM

SEQ ID NO: 1400609 - protein, 9 aa, Homo Sapiens
LERLHLAKH

SEQ ID NO: 1400610 - protein, 9 aa, Homo Sapiens
SHMMTFFIF

SEQ ID NO: 1400611 - protein, 9 aa, Homo Sapiens
GKQVLAGHG

SEQ ID NO: 1400612 - protein, 9 aa, Homo Sapiens
DPKYPQDNH

SEQ ID NO: 1400613 - protein, 9 aa, Homo Sapiens
LRLWSWCGT

SEQ ID NO: 1400614 - protein, 9 aa, Homo Sapiens
PRWARLPQR

SEQ ID NO: 1400615 - protein, 9 aa, Homo Sapiens
QVVLEHLRP

SEQ ID NO: 1400616 - protein, 9 aa, Homo Sapiens
VVGADGVGK

SEQ ID NO: 1400617 - protein, 9 aa, Homo Sapiens
EGLVMYPKV

SEQ ID NO: 1400618 - protein, 9 aa, Homo Sapiens
QLPGLLPLC

SEQ ID NO: 1400619 - protein, 9 aa, Homo Sapiens
YGHQAPQVA

SEQ ID NO: 1400620 - protein, 9 aa, Homo Sapiens
GCLWSGPTS

SEQ ID NO: 1400621 - protein, 9 aa, Homo Sapiens
INDTEFYWR

SEQ ID NO: 1400622 - protein, 9 aa, Homo Sapiens
VFERSSALS

SEQ ID NO: 1400623 - protein, 9 aa, Homo Sapiens
FFMVETLCI

SEQ ID NO: 1400624 - protein, 9 aa, Homo Sapiens
LCNEHFTPS

SEQ ID NO: 1400625 - protein, 9 aa, Homo Sapiens
RDVPGSKRS

SEQ ID NO: 1400626 - protein, 9 aa, Homo Sapiens
QQRHPQGPC

SEQ ID NO: 1400627 - protein, 9 aa, Homo Sapiens
RTGKFALNA

SEQ ID NO: 1400628 - protein, 9 aa, Homo Sapiens
CDANTLPKI

SEQ ID NO: 1400629 - protein, 9 aa, Homo Sapiens
FHSCVAQVY

SEQ ID NO: 1400630 - protein, 9 aa, Homo Sapiens
GIGSCGDRS

SEQ ID NO: 1400631 - protein, 9 aa, Homo Sapiens
CTFVTYDPM

SEQ ID NO: 1400632 - protein, 9 aa, Homo Sapiens
EGIVKNLFK

SEQ ID NO: 1400633 - protein, 9 aa, Homo Sapiens
PRSRRPRFI

SEQ ID NO: 1400634 - protein, 9 aa, Homo Sapiens
RKRPCKSKS

SEQ ID NO: 1400635 - protein, 9 aa, Homo Sapiens
TSKHIKEND

SEQ ID NO: 1400636 - protein, 9 aa, Homo Sapiens
AQPAARATW

SEQ ID NO: 1400637 - protein, 9 aa, Homo Sapiens
RHSSSSNSN

SEQ ID NO: 1400638 - protein, 9 aa, Homo Sapiens
LTSLWLPRR

SEQ ID NO: 1400639 - protein, 9 aa, Homo Sapiens
RDSLPPHED

SEQ ID NO: 1400640 - protein, 9 aa, Homo Sapiens
LIVHVSFIL

SEQ ID NO: 1400641 - protein, 9 aa, Homo Sapiens
CSVCPRSRT

SEQ ID NO: 1400642 - protein, 9 aa, Homo Sapiens
FLRMDGNYN

SEQ ID NO: 1400643 - protein, 9 aa, Homo Sapiens
RGESDMLGM

SEQ ID NO: 1400644 - protein, 9 aa, Homo Sapiens
FSLPINPSY

SEQ ID NO: 1400645 - protein, 9 aa, Homo Sapiens
SSSNSNREV

SEQ ID NO: 1400646 - protein, 9 aa, Homo Sapiens
DLQHALAQA

SEQ ID NO: 1400647 - protein, 9 aa, Homo Sapiens
EAEWHKLLI

SEQ ID NO: 1400648 - protein, 9 aa, Homo Sapiens
YPLFAYMLT

SEQ ID NO: 1400649 - protein, 9 aa, Homo Sapiens
LLCHALQDL

SEQ ID NO: 1400650 - protein, 9 aa, Homo Sapiens
EMTVSGASI

SEQ ID NO: 1400651 - protein, 9 aa, Homo Sapiens
TTKRYHQPG

SEQ ID NO: 1400652 - protein, 9 aa, Homo Sapiens
QIYMLDEHL

SEQ ID NO: 1400653 - protein, 9 aa, Homo Sapiens
TIKIALNTP

SEQ ID NO: 1400654 - protein, 9 aa, Homo Sapiens
FLSGLVNQE

SEQ ID NO: 1400655 - protein, 9 aa, Homo Sapiens
IVMNYVEHN

SEQ ID NO: 1400656 - protein, 9 aa, Homo Sapiens
GCMLKSGWH

SEQ ID NO: 1400657 - protein, 9 aa, Homo Sapiens
ELYEWDNRR

SEQ ID NO: 1400658 - protein, 9 aa, Homo Sapiens
HMQISNAEK

SEQ ID NO: 1400659 - protein, 9 aa, Homo Sapiens
YLDSPDFHE

SEQ ID NO: 1400660 - protein, 9 aa, Homo Sapiens
SKKGPPVKP

SEQ ID NO: 1400661 - protein, 9 aa, Homo Sapiens
AGDWEVQRT

SEQ ID NO: 1400662 - protein, 9 aa, Homo Sapiens
TDMFRQFHA

SEQ ID NO: 1400663 - protein, 9 aa, Homo Sapiens
RNMLERGEA

SEQ ID NO: 1400664 - protein, 9 aa, Homo Sapiens
GVLMLVALD

SEQ ID NO: 1400665 - protein, 9 aa, Homo Sapiens
PSKKSTRPS

SEQ ID NO: 1400666 - protein, 9 aa, Homo Sapiens
HCSATPAPL

SEQ ID NO: 1400667 - protein, 9 aa, Homo Sapiens
VLIPHGPPM

SEQ ID NO: 1400668 - protein, 9 aa, Homo Sapiens
IFVSIAIEH

SEQ ID NO: 1400669 - protein, 9 aa, Homo Sapiens
CGDRSGFGK

SEQ ID NO: 1400670 - protein, 9 aa, Homo Sapiens
SQSAEAGRR

SEQ ID NO: 1400671 - protein, 9 aa, Homo Sapiens
SSQFVRLSW

SEQ ID NO: 1400672 - protein, 9 aa, Homo Sapiens
DHLSTVYDM

SEQ ID NO: 1400673 - protein, 9 aa, Homo Sapiens
LQPGEKKSQ

SEQ ID NO: 1400674 - protein, 9 aa, Homo Sapiens
ALSGLPGLF

SEQ ID NO: 1400675 - protein, 9 aa, Homo Sapiens
LGPCDANTL

SEQ ID NO: 1400676 - protein, 9 aa, Homo Sapiens
LMEPVWHVW

SEQ ID NO: 1400677 - protein, 9 aa, Homo Sapiens
GKHVPRVVH

SEQ ID NO: 1400678 - protein, 9 aa, Homo Sapiens
LPKLLCRQM

SEQ ID NO: 1400679 - protein, 9 aa, Homo Sapiens
HMETVNLLS

SEQ ID NO: 1400680 - protein, 9 aa, Homo Sapiens
STLQQRHPQ

SEQ ID NO: 1400681 - protein, 9 aa, Homo Sapiens
MDFLTLRHL

SEQ ID NO: 1400682 - protein, 9 aa, Homo Sapiens
TRKSSRGTV

SEQ ID NO: 1400683 - protein, 9 aa, Homo Sapiens
ANSGPSPEY

SEQ ID NO: 1400684 - protein, 9 aa, Homo Sapiens
TNFLFLSNC

SEQ ID NO: 1400685 - protein, 9 aa, Homo Sapiens
SQEPSQFER

SEQ ID NO: 1400686 - protein, 9 aa, Homo Sapiens
EASHDTVTF

SEQ ID NO: 1400687 - protein, 9 aa, Homo Sapiens
GCHMVIASR

SEQ ID NO: 1400688 - protein, 9 aa, Homo Sapiens
SETQELAEM

SEQ ID NO: 1400689 - protein, 9 aa, Homo Sapiens
DLRVSEKYL

SEQ ID NO: 1400690 - protein, 9 aa, Homo Sapiens
GEITDDLDV

SEQ ID NO: 1400691 - protein, 9 aa, Homo Sapiens
QTEVFTLFL

SEQ ID NO: 1400692 - protein, 9 aa, Homo Sapiens
TQQSLQAVN

SEQ ID NO: 1400693 - protein, 9 aa, Homo Sapiens
NPPIFHSGM

SEQ ID NO: 1400694 - protein, 9 aa, Homo Sapiens
FRTARKGEK

SEQ ID NO: 1400695 - protein, 9 aa, Homo Sapiens
IGSCGDRSG

SEQ ID NO: 1400696 - protein, 9 aa, Homo Sapiens
STAASTPSS

SEQ ID NO: 1400697 - protein, 9 aa, Homo Sapiens
KQLAYLWME

SEQ ID NO: 1400698 - protein, 9 aa, Homo Sapiens
VRITNSCKN

SEQ ID NO: 1400699 - protein, 9 aa, Homo Sapiens
MWMNMNIMS

SEQ ID NO: 1400700 - protein, 9 aa, Homo Sapiens
KEAQAPCPG

SEQ ID NO: 1400701 - protein, 9 aa, Homo Sapiens
LPINPSYLE

SEQ ID NO: 1400702 - protein, 9 aa, Homo Sapiens
HRSLYFGQS

SEQ ID NO: 1400703 - protein, 9 aa, Homo Sapiens
GQVLGRHCF

SEQ ID NO: 1400704 - protein, 9 aa, Homo Sapiens
EFPVLFLDL

SEQ ID NO: 1400705 - protein, 9 aa, Homo Sapiens
HSQLMFAAL

SEQ ID NO: 1400706 - protein, 9 aa, Homo Sapiens
EPSQFERKD

SEQ ID NO: 1400707 - protein, 9 aa, Homo Sapiens
RHCFEARIC

SEQ ID NO: 1400708 - protein, 9 aa, Homo Sapiens
EPWRAGFQW

SEQ ID NO: 1400709 - protein, 9 aa, Homo Sapiens
MLKSGWHRV

SEQ ID NO: 1400710 - protein, 9 aa, Homo Sapiens
ALLLRSSMY

SEQ ID NO: 1400711 - protein, 9 aa, Homo Sapiens
GTAQWAIPV

SEQ ID NO: 1400712 - protein, 9 aa, Homo Sapiens
TKVQAEICS

SEQ ID NO: 1400713 - protein, 9 aa, Homo Sapiens
PGPTSPSLA

SEQ ID NO: 1400714 - protein, 9 aa, Homo Sapiens
HHWLILESI

SEQ ID NO: 1400715 - protein, 9 aa, Homo Sapiens
TWLSVYSAP

SEQ ID NO: 1400716 - protein, 9 aa, Homo Sapiens
PMCGPDPKY

SEQ ID NO: 1400717 - protein, 9 aa, Homo Sapiens
GVKEAQAPC

SEQ ID NO: 1400718 - protein, 9 aa, Homo Sapiens
INRHCAGRE

SEQ ID NO: 1400719 - protein, 9 aa, Homo Sapiens
KPSATSQER

SEQ ID NO: 1400720 - protein, 9 aa, Homo Sapiens
FGWFDAHGP

SEQ ID NO: 1400721 - protein, 9 aa, Homo Sapiens
MTSSPSYGK

SEQ ID NO: 1400722 - protein, 9 aa, Homo Sapiens
GGGDRPHIS

SEQ ID NO: 1400723 - protein, 9 aa, Homo Sapiens
PQPPQKFAA

SEQ ID NO: 1400724 - protein, 9 aa, Homo Sapiens
TTSDILTLL

SEQ ID NO: 1400725 - protein, 9 aa, Homo Sapiens
ELVDPQPPQ

SEQ ID NO: 1400726 - protein, 9 aa, Homo Sapiens
RVSAPEASH

SEQ ID NO: 1400727 - protein, 9 aa, Homo Sapiens
FCRTTENSR

SEQ ID NO: 1400728 - protein, 9 aa, Homo Sapiens
DKHIHGSPF

SEQ ID NO: 1400729 - protein, 9 aa, Homo Sapiens
LVMYPKVIE

SEQ ID NO: 1400730 - protein, 9 aa, Homo Sapiens
AIHQEDAKA

SEQ ID NO: 1400731 - protein, 9 aa, Homo Sapiens
DGNYNLLPH

SEQ ID NO: 1400732 - protein, 9 aa, Homo Sapiens
MNEKKQTEG

SEQ ID NO: 1400733 - protein, 9 aa, Homo Sapiens
IVKNLFKWA

SEQ ID NO: 1400734 - protein, 9 aa, Homo Sapiens
GGQQERDQA

SEQ ID NO: 1400735 - protein, 9 aa, Homo Sapiens
DCERVGVGQ

SEQ ID NO: 1400736 - protein, 9 aa, Homo Sapiens
NVISHTGME

SEQ ID NO: 1400737 - protein, 9 aa, Homo Sapiens
RRQAKKLHP

SEQ ID NO: 1400738 - protein, 9 aa, Homo Sapiens
MRYFLVKRP

SEQ ID NO: 1400739 - protein, 9 aa, Homo Sapiens
CKPVCSVPV

SEQ ID NO: 1400740 - protein, 9 aa, Homo Sapiens
QSVLLLGVP

SEQ ID NO: 1400741 - protein, 9 aa, Homo Sapiens
AVENEHVNR

SEQ ID NO: 1400742 - protein, 9 aa, Homo Sapiens
LEQQYRALH

SEQ ID NO: 1400743 - protein, 9 aa, Homo Sapiens
LEGSAEMTG

SEQ ID NO: 1400744 - protein, 9 aa, Homo Sapiens
KTMGFKINF

SEQ ID NO: 1400745 - protein, 9 aa, Homo Sapiens
TEVFTLFLV

SEQ ID NO: 1400746 - protein, 9 aa, Homo Sapiens
VSMRYFLVK

SEQ ID NO: 1400747 - protein, 9 aa, Homo Sapiens
VHVSFILVS

SEQ ID NO: 1400748 - protein, 9 aa, Homo Sapiens
HQLQKPPPS

SEQ ID NO: 1400749 - protein, 9 aa, Homo Sapiens
SFHSCVAQV

SEQ ID NO: 1400750 - protein, 9 aa, Homo Sapiens
GAGRPIKRS

SEQ ID NO: 1400751 - protein, 9 aa, Homo Sapiens
QLNGTQQVL

SEQ ID NO: 1400752 - protein, 9 aa, Homo Sapiens
RPSLHRYLS

SEQ ID NO: 1400753 - protein, 9 aa, Homo Sapiens
VQKLKKMRS

SEQ ID NO: 1400754 - protein, 9 aa, Homo Sapiens
KSSEISQGT

SEQ ID NO: 1400755 - protein, 9 aa, Homo Sapiens
ARGAEGHLL

SEQ ID NO: 1400756 - protein, 9 aa, Homo Sapiens
AAVPIVISL

SEQ ID NO: 1400757 - protein, 9 aa, Homo Sapiens
RVLSPTLPQ

SEQ ID NO: 1400758 - protein, 9 aa, Homo Sapiens
DYDGIGSCG

SEQ ID NO: 1400759 - protein, 9 aa, Homo Sapiens
KLMMTLKKP

SEQ ID NO: 1400760 - protein, 9 aa, Homo Sapiens
NGIRTMEDP

SEQ ID NO: 1400761 - protein, 9 aa, Homo Sapiens
DRSPQAPLR

SEQ ID NO: 1400762 - protein, 9 aa, Homo Sapiens
QEFGGVAPR

SEQ ID NO: 1400763 - protein, 9 aa, Homo Sapiens
VGEPRWARL

SEQ ID NO: 1400764 - protein, 9 aa, Homo Sapiens
NEYGIGLSA

SEQ ID NO: 1400765 - protein, 9 aa, Homo Sapiens
SHRSLYFGQ

SEQ ID NO: 1400766 - protein, 9 aa, Homo Sapiens
PTPQPMPPC

SEQ ID NO: 1400767 - protein, 9 aa, Homo Sapiens
RSKALKSTL

SEQ ID NO: 1400768 - protein, 9 aa, Homo Sapiens
DPQPPQKFA

SEQ ID NO: 1400769 - protein, 9 aa, Homo Sapiens
LVAFLVALT

SEQ ID NO: 1400770 - protein, 9 aa, Homo Sapiens
KTKTVKDLG

SEQ ID NO: 1400771 - protein, 9 aa, Homo Sapiens
KDNNYLPCP

SEQ ID NO: 1400772 - protein, 9 aa, Homo Sapiens
MNIMSELKM

SEQ ID NO: 1400773 - protein, 9 aa, Homo Sapiens
WLMSPNRGV

SEQ ID NO: 1400774 - protein, 9 aa, Homo Sapiens
FERSSALST

SEQ ID NO: 1400775 - protein, 9 aa, Homo Sapiens
RSCVCAGPS

SEQ ID NO: 1400776 - protein, 9 aa, Homo Sapiens
ASCASVAIG

SEQ ID NO: 1400777 - protein, 9 aa, Homo Sapiens
EEDSLGGSH

SEQ ID NO: 1400778 - protein, 9 aa, Homo Sapiens
ATCYLLCVR

SEQ ID NO: 1400779 - protein, 9 aa, Homo Sapiens
PVLFKADQS

SEQ ID NO: 1400780 - protein, 9 aa, Homo Sapiens
SGWHRVGEV

SEQ ID NO: 1400781 - protein, 9 aa, Homo Sapiens
RLAWVENAL

SEQ ID NO: 1400782 - protein, 9 aa, Homo Sapiens
LHDNDSRLA

SEQ ID NO: 1400783 - protein, 9 aa, Homo Sapiens
SLTNQSPIE

SEQ ID NO: 1400784 - protein, 9 aa, Homo Sapiens
GTVRTQRRR

SEQ ID NO: 1400785 - protein, 9 aa, Homo Sapiens
QEPSQFERK

SEQ ID NO: 1400786 - protein, 9 aa, Homo Sapiens
TQIRKRPCK

SEQ ID NO: 1400787 - protein, 9 aa, Homo Sapiens
KDTTTKRYH

SEQ ID NO: 1400788 - protein, 9 aa, Homo Sapiens
HVTLAPLPL

SEQ ID NO: 1400789 - protein, 9 aa, Homo Sapiens
LSEEQENTE

SEQ ID NO: 1400790 - protein, 9 aa, Homo Sapiens
SGSPIGAFS

SEQ ID NO: 1400791 - protein, 9 aa, Homo Sapiens
RRSSLLWPA

SEQ ID NO: 1400792 - protein, 9 aa, Homo Sapiens
RTREAQARV

SEQ ID NO: 1400793 - protein, 9 aa, Homo Sapiens
CRQMLPTLS

SEQ ID NO: 1400794 - protein, 9 aa, Homo Sapiens
QANNLLCQL

SEQ ID NO: 1400795 - protein, 9 aa, Homo Sapiens
KPLIESKLP

SEQ ID NO: 1400796 - protein, 9 aa, Homo Sapiens
VKEAQAPCP

SEQ ID NO: 1400797 - protein, 9 aa, Homo Sapiens
HDNRAKLRW

SEQ ID NO: 1400798 - protein, 9 aa, Homo Sapiens
SDILTLLGL

SEQ ID NO: 1400799 - protein, 9 aa, Homo Sapiens
KYPYVCHTE

SEQ ID NO: 1400800 - protein, 9 aa, Homo Sapiens
LLFLRLDVF

SEQ ID NO: 1400801 - protein, 9 aa, Homo Sapiens
FALTKHHWL

SEQ ID NO: 1400802 - protein, 9 aa, Homo Sapiens
IAVQAGDGH

SEQ ID NO: 1400803 - protein, 9 aa, Homo Sapiens
GPKYWRRST

SEQ ID NO: 1400804 - protein, 9 aa, Homo Sapiens
ICGAIVRPV

SEQ ID NO: 1400805 - protein, 9 aa, Homo Sapiens
ASSGASAAA

SEQ ID NO: 1400806 - protein, 9 aa, Homo Sapiens
PMRSLGEPW

SEQ ID NO: 1400807 - protein, 9 aa, Homo Sapiens
CYLLCVRRK

SEQ ID NO: 1400808 - protein, 9 aa, Homo Sapiens
PTPCSRWCS

SEQ ID NO: 1400809 - protein, 9 aa, Homo Sapiens
NQASNKKDI

SEQ ID NO: 1400810 - protein, 9 aa, Homo Sapiens
QCQSSFNIC

SEQ ID NO: 1400811 - protein, 9 aa, Homo Sapiens
DGSGKGRRS

SEQ ID NO: 1400812 - protein, 9 aa, Homo Sapiens
NEILKRLKY

SEQ ID NO: 1400813 - protein, 9 aa, Homo Sapiens
DDISILNEH

SEQ ID NO: 1400814 - protein, 9 aa, Homo Sapiens
GNGTKNSCS

SEQ ID NO: 1400815 - protein, 9 aa, Homo Sapiens
LCHFTSIKV

SEQ ID NO: 1400816 - protein, 9 aa, Homo Sapiens
THAPARSSS

SEQ ID NO: 1400817 - protein, 9 aa, Homo Sapiens
SRVDVMKLL

SEQ ID NO: 1400818 - protein, 9 aa, Homo Sapiens
NMNIMSELK

SEQ ID NO: 1400819 - protein, 9 aa, Homo Sapiens
AEQEMVCMV

SEQ ID NO: 1400820 - protein, 9 aa, Homo Sapiens
KEKSKHGLF

SEQ ID NO: 1400821 - protein, 9 aa, Homo Sapiens
TNVHPGVTI

SEQ ID NO: 1400822 - protein, 9 aa, Homo Sapiens
HIHGSPFTA

SEQ ID NO: 1400823 - protein, 9 aa, Homo Sapiens
NSKLTKVQA

SEQ ID NO: 1400824 - protein, 9 aa, Homo Sapiens
NAFIWGLAA

SEQ ID NO: 1400825 - protein, 9 aa, Homo Sapiens
SLGNSLKQI

SEQ ID NO: 1400826 - protein, 9 aa, Homo Sapiens
WKRKSTSWC

SEQ ID NO: 1400827 - protein, 9 aa, Homo Sapiens
VVLQVLAEE

SEQ ID NO: 1400828 - protein, 9 aa, Homo Sapiens
PLIESKLPV

SEQ ID NO: 1400829 - protein, 9 aa, Homo Sapiens
RVLDGTHCG

SEQ ID NO: 1400830 - protein, 9 aa, Homo Sapiens
GLDDRSPQA

SEQ ID NO: 1400831 - protein, 9 aa, Homo Sapiens
QSPIEFPDT

SEQ ID NO: 1400832 - protein, 9 aa, Homo Sapiens
ALPFFLLFT

SEQ ID NO: 1400833 - protein, 9 aa, Homo Sapiens
VVAPVHETC

SEQ ID NO: 1400834 - protein, 9 aa, Homo Sapiens
DVICSGPES

SEQ ID NO: 1400835 - protein, 9 aa, Homo Sapiens
IVSIFTFMG

SEQ ID NO: 1400836 - protein, 9 aa, Homo Sapiens
LLGASAPCG

SEQ ID NO: 1400837 - protein, 9 aa, Homo Sapiens
VSSQFVRLS

SEQ ID NO: 1400838 - protein, 9 aa, Homo Sapiens
RGMMSEIDR

SEQ ID NO: 1400839 - protein, 9 aa, Homo Sapiens
HVTWSMQED

SEQ ID NO: 1400840 - protein, 9 aa, Homo Sapiens
ELESRLVGL

SEQ ID NO: 1400841 - protein, 9 aa, Homo Sapiens
DRVLDGTHC

SEQ ID NO: 1400842 - protein, 9 aa, Homo Sapiens
LEVILPNPR

SEQ ID NO: 1400843 - protein, 9 aa, Homo Sapiens
LCRQMLPTL

SEQ ID NO: 1400844 - protein, 9 aa, Homo Sapiens
GAREAGRFA

SEQ ID NO: 1400845 - protein, 9 aa, Homo Sapiens
LLGSNKSPA

SEQ ID NO: 1400846 - protein, 9 aa, Homo Sapiens
LLTAVLVLI

SEQ ID NO: 1400847 - protein, 9 aa, Homo Sapiens
PALTSLPGP

SEQ ID NO: 1400848 - protein, 9 aa, Homo Sapiens
VSHRGCKAK

SEQ ID NO: 1400849 - protein, 9 aa, Homo Sapiens
MWLSFSLPI

SEQ ID NO: 1400850 - protein, 9 aa, Homo Sapiens
KQKREDEAP

SEQ ID NO: 1400851 - protein, 9 aa, Homo Sapiens
TPSCGTTTA

SEQ ID NO: 1400852 - protein, 9 aa, Homo Sapiens
QVLAGHGAS

SEQ ID NO: 1400853 - protein, 9 aa, Homo Sapiens
QDNHEHQEA

SEQ ID NO: 1400854 - protein, 9 aa, Homo Sapiens
RFAHPQEIL

SEQ ID NO: 1400855 - protein, 9 aa, Homo Sapiens
GPPVKPNMP

SEQ ID NO: 1400856 - protein, 9 aa, Homo Sapiens
HPTMWLSFS

SEQ ID NO: 1400857 - protein, 9 aa, Homo Sapiens
SALGHLHSI

SEQ ID NO: 1400858 - protein, 9 aa, Homo Sapiens
GTFLCLCHQ

SEQ ID NO: 1400859 - protein, 9 aa, Homo Sapiens
PINAFIWGL

SEQ ID NO: 1400860 - protein, 9 aa, Homo Sapiens
SGCTYQDVG

SEQ ID NO: 1400861 - protein, 9 aa, Homo Sapiens
DTLRMTKPE

SEQ ID NO: 1400862 - protein, 9 aa, Homo Sapiens
TEPFMTHSI

SEQ ID NO: 1400863 - protein, 9 aa, Homo Sapiens
KYGVHKIIY

SEQ ID NO: 1400864 - protein, 9 aa, Homo Sapiens
HLSTVYDMQ

SEQ ID NO: 1400865 - protein, 9 aa, Homo Sapiens
VSGDLAPLS

SEQ ID NO: 1400866 - protein, 9 aa, Homo Sapiens
EVVAPVHET

SEQ ID NO: 1400867 - protein, 9 aa, Homo Sapiens
PEKGTVGVS

SEQ ID NO: 1400868 - protein, 9 aa, Homo Sapiens
GHQAPQVAM

SEQ ID NO: 1400869 - protein, 9 aa, Homo Sapiens
PGPNQILPA

SEQ ID NO: 1400870 - protein, 9 aa, Homo Sapiens
EDFIQPNSR

SEQ ID NO: 1400871 - protein, 9 aa, Homo Sapiens
NNELIMDQY

SEQ ID NO: 1400872 - protein, 9 aa, Homo Sapiens
MVCMVRAAT

SEQ ID NO: 1400873 - protein, 9 aa, Homo Sapiens
ATELNIRES

SEQ ID NO: 1400874 - protein, 9 aa, Homo Sapiens
PQIDKEATI

SEQ ID NO: 1400875 - protein, 9 aa, Homo Sapiens
KDLLHLDMA

SEQ ID NO: 1400876 - protein, 9 aa, Homo Sapiens
EGHKKAFAT

SEQ ID NO: 1400877 - protein, 9 aa, Homo Sapiens
EWFEHMNSV

SEQ ID NO: 1400878 - protein, 9 aa, Homo Sapiens
TASTRPQDG

SEQ ID NO: 1400879 - protein, 9 aa, Homo Sapiens
TICGLTRPE

SEQ ID NO: 1400880 - protein, 9 aa, Homo Sapiens
YICTAQNPI

SEQ ID NO: 1400881 - protein, 9 aa, Homo Sapiens
NCRSAGDDC

SEQ ID NO: 1400882 - protein, 9 aa, Homo Sapiens
DVYHGQGIQ

SEQ ID NO: 1400883 - protein, 9 aa, Homo Sapiens
TNEPTTGML

SEQ ID NO: 1400884 - protein, 9 aa, Homo Sapiens
KPHSCPYMA

SEQ ID NO: 1400885 - protein, 9 aa, Homo Sapiens
GFSLAKTWC

SEQ ID NO: 1400886 - protein, 9 aa, Homo Sapiens
GASASRHAG

SEQ ID NO: 1400887 - protein, 9 aa, Homo Sapiens
ERVGVGQVV

SEQ ID NO: 1400888 - protein, 9 aa, Homo Sapiens
PVAFFFSGW

SEQ ID NO: 1400889 - protein, 9 aa, Homo Sapiens
NHLLYSVSM

SEQ ID NO: 1400890 - protein, 9 aa, Homo Sapiens
CGHSEDADV

SEQ ID NO: 1400891 - protein, 9 aa, Homo Sapiens
NEESDNKKE

SEQ ID NO: 1400892 - protein, 9 aa, Homo Sapiens
AVLDLQRCA

SEQ ID NO: 1400893 - protein, 9 aa, Homo Sapiens
VYFFQAESK

SEQ ID NO: 1400894 - protein, 9 aa, Homo Sapiens
MRHGCHMVI

SEQ ID NO: 1400895 - protein, 9 aa, Homo Sapiens
ALVGGEITD

SEQ ID NO: 1400896 - protein, 9 aa, Homo Sapiens
LLFTATSSL

SEQ ID NO: 1400897 - protein, 9 aa, Homo Sapiens
SLAAWDAPC

SEQ ID NO: 1400898 - protein, 9 aa, Homo Sapiens
PVWHVWTTL

SEQ ID NO: 1400899 - protein, 9 aa, Homo Sapiens
LVYHRRLHA

SEQ ID NO: 1400900 - protein, 9 aa, Homo Sapiens
WKEKSKRDR

SEQ ID NO: 1400901 - protein, 9 aa, Homo Sapiens
AGARHHTRE

SEQ ID NO: 1400902 - protein, 9 aa, Homo Sapiens
NPAVAKKTI

SEQ ID NO: 1400903 - protein, 9 aa, Homo Sapiens
QDRKSEECS

SEQ ID NO: 1400904 - protein, 9 aa, Homo Sapiens
STSNEGGRW

SEQ ID NO: 1400905 - protein, 9 aa, Homo Sapiens
VLGVFYNEI

SEQ ID NO: 1400906 - protein, 9 aa, Homo Sapiens
PVSKKAHPL

SEQ ID NO: 1400907 - protein, 9 aa, Homo Sapiens
LTPFLGPII

SEQ ID NO: 1400908 - protein, 9 aa, Homo Sapiens
EAARVLSPT

SEQ ID NO: 1400909 - protein, 9 aa, Homo Sapiens
PKNKENIFV

SEQ ID NO: 1400910 - protein, 9 aa, Homo Sapiens
RESRERNAK

SEQ ID NO: 1400911 - protein, 9 aa, Homo Sapiens
LSTCTARFI

SEQ ID NO: 1400912 - protein, 9 aa, Homo Sapiens
WCGTSQTYF

SEQ ID NO: 1400913 - protein, 9 aa, Homo Sapiens
IIAPLDERM

SEQ ID NO: 1400914 - protein, 9 aa, Homo Sapiens
LLKDQKPKN

SEQ ID NO: 1400915 - protein, 9 aa, Homo Sapiens
ILGRVSAPE

SEQ ID NO: 1400916 - protein, 9 aa, Homo Sapiens
KNLRMLPLK

SEQ ID NO: 1400917 - protein, 9 aa, Homo Sapiens
AGRRANTSA

SEQ ID NO: 1400918 - protein, 9 aa, Homo Sapiens
DQGGAAQLN

SEQ ID NO: 1400919 - protein, 9 aa, Homo Sapiens
FKSHVYFFQ

SEQ ID NO: 1400920 - protein, 9 aa, Homo Sapiens
HLTPTQIRK

SEQ ID NO: 1400921 - protein, 9 aa, Homo Sapiens
LEVNVEALI

SEQ ID NO: 1400922 - protein, 9 aa, Homo Sapiens
GTVGVSGDL

SEQ ID NO: 1400923 - protein, 9 aa, Homo Sapiens
ALPKKKKVW

SEQ ID NO: 1400924 - protein, 9 aa, Homo Sapiens
YFLDHFGNM

SEQ ID NO: 1400925 - protein, 9 aa, Homo Sapiens
AGAEREHHS

SEQ ID NO: 1400926 - protein, 9 aa, Homo Sapiens
ISQRSSLPV

SEQ ID NO: 1400927 - protein, 9 aa, Homo Sapiens
SHDQLRKKV

SEQ ID NO: 1400928 - protein, 9 aa, Homo Sapiens
KGKGHRRKE

SEQ ID NO: 1400929 - protein, 9 aa, Homo Sapiens
SLPGPNQIL

SEQ ID NO: 1400930 - protein, 9 aa, Homo Sapiens
RWIRIIPDV

SEQ ID NO: 1400931 - protein, 9 aa, Homo Sapiens
EEINKHTAA

SEQ ID NO: 1400932 - protein, 9 aa, Homo Sapiens
LSDPEDERL

SEQ ID NO: 1400933 - protein, 9 aa, Homo Sapiens
TLTEHKVMH

SEQ ID NO: 1400934 - protein, 9 aa, Homo Sapiens
TVCRESERD

SEQ ID NO: 1400935 - protein, 9 aa, Homo Sapiens
VFLNPVACK

SEQ ID NO: 1400936 - protein, 9 aa, Homo Sapiens
RRVLLDQFS

SEQ ID NO: 1400937 - protein, 9 aa, Homo Sapiens
LGNSLKQIH

SEQ ID NO: 1400938 - protein, 9 aa, Homo Sapiens
VDLSYMVFM

SEQ ID NO: 1400939 - protein, 9 aa, Homo Sapiens
SCASVAIGK

SEQ ID NO: 1400940 - protein, 9 aa, Homo Sapiens
GHRRKEIWR

SEQ ID NO: 1400941 - protein, 9 aa, Homo Sapiens
DCWDSPDGM

SEQ ID NO: 1400942 - protein, 9 aa, Homo Sapiens
FHTLLIRVE

SEQ ID NO: 1400943 - protein, 9 aa, Homo Sapiens
HTLLIRVEN

SEQ ID NO: 1400944 - protein, 9 aa, Homo Sapiens
PPVLFKADQ

SEQ ID NO: 1400945 - protein, 9 aa, Homo Sapiens
ASSHRLRVL

SEQ ID NO: 1400946 - protein, 9 aa, Homo Sapiens
QIWSIVHKY

SEQ ID NO: 1400947 - protein, 9 aa, Homo Sapiens
FSKVGPWVR

SEQ ID NO: 1400948 - protein, 9 aa, Homo Sapiens
RQTVTQPFQ

SEQ ID NO: 1400949 - protein, 9 aa, Homo Sapiens
VHKYMQKEG

SEQ ID NO: 1400950 - protein, 9 aa, Homo Sapiens
LVLIGLHGV

SEQ ID NO: 1400951 - protein, 9 aa, Homo Sapiens
ATVFLNPVA

SEQ ID NO: 1400952 - protein, 9 aa, Homo Sapiens
ARVLSPTLP

SEQ ID NO: 1400953 - protein, 9 aa, Homo Sapiens
IRTMEDPGV

SEQ ID NO: 1400954 - protein, 9 aa, Homo Sapiens
VLSKSSGCT

SEQ ID NO: 1400955 - protein, 9 aa, Homo Sapiens
CTISFRQST

SEQ ID NO: 1400956 - protein, 9 aa, Homo Sapiens
STAPTLSTA

SEQ ID NO: 1400957 - protein, 9 aa, Homo Sapiens
QEKLCLTRI

SEQ ID NO: 1400958 - protein, 9 aa, Homo Sapiens
RRPRFIRCL

SEQ ID NO: 1400959 - protein, 9 aa, Homo Sapiens
CNHGEVQCT

SEQ ID NO: 1400960 - protein, 9 aa, Homo Sapiens
EINTEPAVD

SEQ ID NO: 1400961 - protein, 9 aa, Homo Sapiens
EIRKANIPN

SEQ ID NO: 1400962 - protein, 9 aa, Homo Sapiens
IDEYKKTYM

SEQ ID NO: 1400963 - protein, 9 aa, Homo Sapiens
SARSRARTR

SEQ ID NO: 1400964 - protein, 9 aa, Homo Sapiens
SEKAGDWEV

SEQ ID NO: 1400965 - protein, 9 aa, Homo Sapiens
PRSESMWRQ

SEQ ID NO: 1400966 - protein, 9 aa, Homo Sapiens
LARLCQSLG

SEQ ID NO: 1400967 - protein, 9 aa, Homo Sapiens
SYDPLALSG

SEQ ID NO: 1400968 - protein, 9 aa, Homo Sapiens
YLMEPVWHV

SEQ ID NO: 1400969 - protein, 9 aa, Homo Sapiens
ASVAIGKLA

SEQ ID NO: 1400970 - protein, 9 aa, Homo Sapiens
VIFYSLICM

SEQ ID NO: 1400971 - protein, 9 aa, Homo Sapiens
ASEEAIKKT

SEQ ID NO: 1400972 - protein, 9 aa, Homo Sapiens
PPQGLKMSA

SEQ ID NO: 1400973 - protein, 9 aa, Homo Sapiens
ILPWRNQAS

SEQ ID NO: 1400974 - protein, 9 aa, Homo Sapiens
TVPPGPPGP

SEQ ID NO: 1400975 - protein, 9 aa, Homo Sapiens
RDRNTRILG

SEQ ID NO: 1400976 - protein, 9 aa, Homo Sapiens
ALLCHALQD

SEQ ID NO: 1400977 - protein, 9 aa, Homo Sapiens
AVEFDGGIV

SEQ ID NO: 1400978 - protein, 9 aa, Homo Sapiens
HLISKFGDL

SEQ ID NO: 1400979 - protein, 9 aa, Homo Sapiens
RKANIPNMD

SEQ ID NO: 1400980 - protein, 9 aa, Homo Sapiens
DAQQAMAMV

SEQ ID NO: 1400981 - protein, 9 aa, Homo Sapiens
LFKADQSES

SEQ ID NO: 1400982 - protein, 9 aa, Homo Sapiens
GSSTGPSTR

SEQ ID NO: 1400983 - protein, 9 aa, Homo Sapiens
LHANSGPSP

SEQ ID NO: 1400984 - protein, 9 aa, Homo Sapiens
PQPMPPCSP

SEQ ID NO: 1400985 - protein, 9 aa, Homo Sapiens
RPCCRPACC

SEQ ID NO: 1400986 - protein, 9 aa, Homo Sapiens
LAQEGRFGL

SEQ ID NO: 1400987 - protein, 9 aa, Homo Sapiens
CHALQDLDS

SEQ ID NO: 1400988 - protein, 9 aa, Homo Sapiens
MCLAQLSEE

SEQ ID NO: 1400989 - protein, 9 aa, Homo Sapiens
VSSWPEEAV

SEQ ID NO: 1400990 - protein, 9 aa, Homo Sapiens
ALPPGPPWG

SEQ ID NO: 1400991 - protein, 9 aa, Homo Sapiens
PGASLLLQP

SEQ ID NO: 1400992 - protein, 9 aa, Homo Sapiens
KGTVGVSGD

SEQ ID NO: 1400993 - protein, 9 aa, Homo Sapiens
VFYLMEPVW

SEQ ID NO: 1400994 - protein, 9 aa, Homo Sapiens
VKVKFEDIK

SEQ ID NO: 1400995 - protein, 9 aa, Homo Sapiens
SAISKEIIA

SEQ ID NO: 1400996 - protein, 9 aa, Homo Sapiens
PLFAYMLTA

SEQ ID NO: 1400997 - protein, 9 aa, Homo Sapiens
ASLEPKNKV

SEQ ID NO: 1400998 - protein, 9 aa, Homo Sapiens
IEPVGNHEE

SEQ ID NO: 1400999 - protein, 9 aa, Homo Sapiens
NPDVPPPVL

SEQ ID NO: 1401000 - protein, 9 aa, Homo Sapiens
SIIGGTDQA

SEQ ID NO: 1401001 - protein, 9 aa, Homo Sapiens
ESLEIPLLF

SEQ ID NO: 1401002 - protein, 9 aa, Homo Sapiens
KKGPPVKPN

SEQ ID NO: 1401003 - protein, 9 aa, Homo Sapiens
HEGNFGAVG

SEQ ID NO: 1401004 - protein, 9 aa, Homo Sapiens
LGPIIFSLR

SEQ ID NO: 1401005 - protein, 9 aa, Homo Sapiens
KGPPVKPNM

SEQ ID NO: 1401006 - protein, 9 aa, Homo Sapiens
RKVVCEQNL

SEQ ID NO: 1401007 - protein, 9 aa, Homo Sapiens
QRDLFRVVT

SEQ ID NO: 1401008 - protein, 9 aa, Homo Sapiens
TVFKGSKNL

SEQ ID NO: 1401009 - protein, 9 aa, Homo Sapiens
KVMHSKSLD

SEQ ID NO: 1401010 - protein, 9 aa, Homo Sapiens
PLRVQSVLL

SEQ ID NO: 1401011 - protein, 9 aa, Homo Sapiens
APALSWFPE

SEQ ID NO: 1401012 - protein, 9 aa, Homo Sapiens
HRDLFLHHK

SEQ ID NO: 1401013 - protein, 9 aa, Homo Sapiens
GGSHVVVCD

SEQ ID NO: 1401014 - protein, 9 aa, Homo Sapiens
AVDISPGPT

SEQ ID NO: 1401015 - protein, 9 aa, Homo Sapiens
NPQPAFGGA

SEQ ID NO: 1401016 - protein, 9 aa, Homo Sapiens
CPSSSKCHN

SEQ ID NO: 1401017 - protein, 9 aa, Homo Sapiens
WVENALNNL

SEQ ID NO: 1401018 - protein, 9 aa, Homo Sapiens
VIVFELTCQ

SEQ ID NO: 1401019 - protein, 9 aa, Homo Sapiens
WYSWRRGQE

SEQ ID NO: 1401020 - protein, 9 aa, Homo Sapiens
VCDIPPQGL

SEQ ID NO: 1401021 - protein, 9 aa, Homo Sapiens
ISENQANNL

SEQ ID NO: 1401022 - protein, 9 aa, Homo Sapiens
PESAGPLLH

SEQ ID NO: 1401023 - protein, 9 aa, Homo Sapiens
SNCHNSKLT

SEQ ID NO: 1401024 - protein, 9 aa, Homo Sapiens
NVHPGVTIR

SEQ ID NO: 1401025 - protein, 9 aa, Homo Sapiens
KHIGKVVLQ

SEQ ID NO: 1401026 - protein, 9 aa, Homo Sapiens
KPKNKENIF

SEQ ID NO: 1401027 - protein, 9 aa, Homo Sapiens
TLVLAQEGR

SEQ ID NO: 1401028 - protein, 9 aa, Homo Sapiens
GSFARGAEG

SEQ ID NO: 1401029 - protein, 9 aa, Homo Sapiens
IKKTWTSAR

SEQ ID NO: 1401030 - protein, 9 aa, Homo Sapiens
SLQAVNKSG

SEQ ID NO: 1401031 - protein, 9 aa, Homo Sapiens
TGVHGFARS

SEQ ID NO: 1401032 - protein, 9 aa, Homo Sapiens
CQIAHILPV

SEQ ID NO: 1401033 - protein, 9 aa, Homo Sapiens
FLEILRRSS

SEQ ID NO: 1401034 - protein, 9 aa, Homo Sapiens
ISPFSTVCR

SEQ ID NO: 1401035 - protein, 9 aa, Homo Sapiens
ITNSCKNPS

SEQ ID NO: 1401036 - protein, 9 aa, Homo Sapiens
VVLPIQFKQ

SEQ ID NO: 1401037 - protein, 9 aa, Homo Sapiens
SLICMYTLW

SEQ ID NO: 1401038 - protein, 9 aa, Homo Sapiens
LGHLHSIKI

SEQ ID NO: 1401039 - protein, 9 aa, Homo Sapiens
PLFGASRVD

SEQ ID NO: 1401040 - protein, 9 aa, Homo Sapiens
NQANNLLCQ

SEQ ID NO: 1401041 - protein, 9 aa, Homo Sapiens
PMLPSHDQL

SEQ ID NO: 1401042 - protein, 9 aa, Homo Sapiens
GASIWTWSC

SEQ ID NO: 1401043 - protein, 9 aa, Homo Sapiens
TEGGRRHGY

SEQ ID NO: 1401044 - protein, 9 aa, Homo Sapiens
GACFAQAHF

SEQ ID NO: 1401045 - protein, 9 aa, Homo Sapiens
FFFLRMDGN

SEQ ID NO: 1401046 - protein, 9 aa, Homo Sapiens
SCCRPCCRP

SEQ ID NO: 1401047 - protein, 9 aa, Homo Sapiens
GSPIGAFSL

SEQ ID NO: 1401048 - protein, 9 aa, Homo Sapiens
GFLDDGRVD

SEQ ID NO: 1401049 - protein, 9 aa, Homo Sapiens
LSTLQQRHP

SEQ ID NO: 1401050 - protein, 9 aa, Homo Sapiens
WEQKKFMGT

SEQ ID NO: 1401051 - protein, 9 aa, Homo Sapiens
FLLLLTAVL

SEQ ID NO: 1401052 - protein, 9 aa, Homo Sapiens
EAATKPLPT

SEQ ID NO: 1401053 - protein, 9 aa, Homo Sapiens
SLQVVLEHL

SEQ ID NO: 1401054 - protein, 9 aa, Homo Sapiens
DEYKKTYME

SEQ ID NO: 1401055 - protein, 9 aa, Homo Sapiens
VHPGVTIRK

SEQ ID NO: 1401056 - protein, 9 aa, Homo Sapiens
SAPALRGES

SEQ ID NO: 1401057 - protein, 9 aa, Homo Sapiens
VQLSRFAHP

SEQ ID NO: 1401058 - protein, 9 aa, Homo Sapiens
PRFIRCLMT

SEQ ID NO: 1401059 - protein, 9 aa, Homo Sapiens
QCRQEFGGV

SEQ ID NO: 1401060 - protein, 9 aa, Homo Sapiens
SSLWESLEI

SEQ ID NO: 1401061 - protein, 9 aa, Homo Sapiens
DTGPGKQKR

SEQ ID NO: 1401062 - protein, 9 aa, Homo Sapiens
IGGGTPLSI

SEQ ID NO: 1401063 - protein, 9 aa, Homo Sapiens
SDAQQAMAM

SEQ ID NO: 1401064 - protein, 9 aa, Homo Sapiens
FSTLKPPTP

SEQ ID NO: 1401065 - protein, 9 aa, Homo Sapiens
EGGWTNNQH

SEQ ID NO: 1401066 - protein, 9 aa, Homo Sapiens
YELEKHVER

SEQ ID NO: 1401067 - protein, 9 aa, Homo Sapiens
LPPKFCRTT

SEQ ID NO: 1401068 - protein, 9 aa, Homo Sapiens
LRRVLLDQF

SEQ ID NO: 1401069 - protein, 9 aa, Homo Sapiens
NELWSKQLL

SEQ ID NO: 1401070 - protein, 9 aa, Homo Sapiens
EELTNTLEI

SEQ ID NO: 1401071 - protein, 9 aa, Homo Sapiens
SPRVAHACA

SEQ ID NO: 1401072 - protein, 9 aa, Homo Sapiens
LRGESDMLG

SEQ ID NO: 1401073 - protein, 9 aa, Homo Sapiens
PSVEEIKLT

SEQ ID NO: 1401074 - protein, 9 aa, Homo Sapiens
AHSQSAEAG

SEQ ID NO: 1401075 - protein, 9 aa, Homo Sapiens
WLPRRRSTE

SEQ ID NO: 1401076 - protein, 9 aa, Homo Sapiens
SDIIYKKLL

SEQ ID NO: 1401077 - protein, 9 aa, Homo Sapiens
LPFFLLFTW

SEQ ID NO: 1401078 - protein, 9 aa, Homo Sapiens
LEKMGNFLA

SEQ ID NO: 1401079 - protein, 9 aa, Homo Sapiens
PCLWVVPGA

SEQ ID NO: 1401080 - protein, 9 aa, Homo Sapiens
GLQGSPHVT

SEQ ID NO: 1401081 - protein, 9 aa, Homo Sapiens
GGNNELIMD

SEQ ID NO: 1401082 - protein, 9 aa, Homo Sapiens
WTNNQHCLI

SEQ ID NO: 1401083 - protein, 9 aa, Homo Sapiens
CSGWATSTA

SEQ ID NO: 1401084 - protein, 9 aa, Homo Sapiens
CVSSCCRPC

SEQ ID NO: 1401085 - protein, 9 aa, Homo Sapiens
DIPPQGLKM

SEQ ID NO: 1401086 - protein, 9 aa, Homo Sapiens
QVGGRLVLK

SEQ ID NO: 1401087 - protein, 9 aa, Homo Sapiens
TKAVGCCHT

SEQ ID NO: 1401088 - protein, 9 aa, Homo Sapiens
KYNDKHIHG

SEQ ID NO: 1401089 - protein, 9 aa, Homo Sapiens
SNPPVWYSW

SEQ ID NO: 1401090 - protein, 9 aa, Homo Sapiens
ESMWRQCSD

SEQ ID NO: 1401091 - protein, 9 aa, Homo Sapiens
ISCNICQIC

SEQ ID NO: 1401092 - protein, 9 aa, Homo Sapiens
VLEHLRPSW

SEQ ID NO: 1401093 - protein, 9 aa, Homo Sapiens
NRLLHFAHM

SEQ ID NO: 1401094 - protein, 9 aa, Homo Sapiens
DYTLTQMGP

SEQ ID NO: 1401095 - protein, 9 aa, Homo Sapiens
CQEQFLCSE

SEQ ID NO: 1401096 - protein, 9 aa, Homo Sapiens
LASRVAGTA

SEQ ID NO: 1401097 - protein, 9 aa, Homo Sapiens
TLPLLQQTA

SEQ ID NO: 1401098 - protein, 9 aa, Homo Sapiens
TAPTLSTAA

SEQ ID NO: 1401099 - protein, 9 aa, Homo Sapiens
GPCDANTLP

SEQ ID NO: 1401100 - protein, 9 aa, Homo Sapiens
TKNSCSRTR

SEQ ID NO: 1401101 - protein, 9 aa, Homo Sapiens
RREDKVHVL

SEQ ID NO: 1401102 - protein, 9 aa, Homo Sapiens
FLSNCHNSK

SEQ ID NO: 1401103 - protein, 9 aa, Homo Sapiens
LPVAFFFSG

SEQ ID NO: 1401104 - protein, 9 aa, Homo Sapiens
VKGPGRNYY

SEQ ID NO: 1401105 - protein, 9 aa, Homo Sapiens
SGAALFGDK

SEQ ID NO: 1401106 - protein, 9 aa, Homo Sapiens
NSGGGDRPH

SEQ ID NO: 1401107 - protein, 9 aa, Homo Sapiens
NGGVCHHIT

SEQ ID NO: 1401108 - protein, 9 aa, Homo Sapiens
TPFLGPIIF

SEQ ID NO: 1401109 - protein, 9 aa, Homo Sapiens
HLMWMNMNI

SEQ ID NO: 1401110 - protein, 9 aa, Homo Sapiens
MNELWSKQL

SEQ ID NO: 1401111 - protein, 9 aa, Homo Sapiens
LDTEGAFTV

SEQ ID NO: 1401112 - protein, 9 aa, Homo Sapiens
LPFNDPFFM

SEQ ID NO: 1401113 - protein, 9 aa, Homo Sapiens
SSTGPSTRR

SEQ ID NO: 1401114 - protein, 9 aa, Homo Sapiens
LRLLCSIIG

SEQ ID NO: 1401115 - protein, 9 aa, Homo Sapiens
TQQSNSCPE

SEQ ID NO: 1401116 - protein, 9 aa, Homo Sapiens
DSKTQATTS

SEQ ID NO: 1401117 - protein, 9 aa, Homo Sapiens
LAVLKDWAE

SEQ ID NO: 1401118 - protein, 9 aa, Homo Sapiens
VISHTGMEH

SEQ ID NO: 1401119 - protein, 9 aa, Homo Sapiens
GFAMYTTCI

SEQ ID NO: 1401120 - protein, 9 aa, Homo Sapiens
EAQVAEDRP

SEQ ID NO: 1401121 - protein, 9 aa, Homo Sapiens
HPDMKQVYN

SEQ ID NO: 1401122 - protein, 9 aa, Homo Sapiens
SDIDEYKKT

SEQ ID NO: 1401123 - protein, 9 aa, Homo Sapiens
LHWRIGGGT

SEQ ID NO: 1401124 - protein, 9 aa, Homo Sapiens
YNEILKRLK

SEQ ID NO: 1401125 - protein, 9 aa, Homo Sapiens
HTREIFVLF

SEQ ID NO: 1401126 - protein, 9 aa, Homo Sapiens
AHPQEILRD

SEQ ID NO: 1401127 - protein, 9 aa, Homo Sapiens
EDNSNINPR

SEQ ID NO: 1401128 - protein, 9 aa, Homo Sapiens
HHDHNCRSA

SEQ ID NO: 1401129 - protein, 9 aa, Homo Sapiens
RDSTNFLFL

SEQ ID NO: 1401130 - protein, 9 aa, Homo Sapiens
DAPCPLLEG

SEQ ID NO: 1401131 - protein, 9 aa, Homo Sapiens
DGVKAELHI

SEQ ID NO: 1401132 - protein, 9 aa, Homo Sapiens
VKIHHSHAL

SEQ ID NO: 1401133 - protein, 9 aa, Homo Sapiens
KKETEKSDS

SEQ ID NO: 1401134 - protein, 9 aa, Homo Sapiens
RLVCGRHSS

SEQ ID NO: 1401135 - protein, 9 aa, Homo Sapiens
FLIVHVSFI

SEQ ID NO: 1401136 - protein, 9 aa, Homo Sapiens
SGSEATSQY

SEQ ID NO: 1401137 - protein, 9 aa, Homo Sapiens
RDGQVLGRH

SEQ ID NO: 1401138 - protein, 9 aa, Homo Sapiens
AAVAWAAAP

SEQ ID NO: 1401139 - protein, 9 aa, Homo Sapiens
SLYFGQSQR

SEQ ID NO: 1401140 - protein, 9 aa, Homo Sapiens
LLEQHQLQK

SEQ ID NO: 1401141 - protein, 9 aa, Homo Sapiens
AAAVAWAAA

SEQ ID NO: 1401142 - protein, 9 aa, Homo Sapiens
ALRRSWRYR

SEQ ID NO: 1401143 - protein, 9 aa, Homo Sapiens
NMGNSLIEC

SEQ ID NO: 1401144 - protein, 9 aa, Homo Sapiens
GRLVLKAIV

SEQ ID NO: 1401145 - protein, 9 aa, Homo Sapiens
PSGSSSKIR

SEQ ID NO: 1401146 - protein, 9 aa, Homo Sapiens
DHNCRSAGD

SEQ ID NO: 1401147 - protein, 9 aa, Homo Sapiens
LVWKFFLVF

SEQ ID NO: 1401148 - protein, 9 aa, Homo Sapiens
LFVLGTAQW

SEQ ID NO: 1401149 - protein, 9 aa, Homo Sapiens
VEHPDMKQV

SEQ ID NO: 1401150 - protein, 9 aa, Homo Sapiens
GKLALLGAS

SEQ ID NO: 1401151 - protein, 9 aa, Homo Sapiens
VVNHSNDCC

SEQ ID NO: 1401152 - protein, 9 aa, Homo Sapiens
IVCGKAFPW

SEQ ID NO: 1401153 - protein, 9 aa, Homo Sapiens
RIASSVSPP

SEQ ID NO: 1401154 - protein, 9 aa, Homo Sapiens
TVTFRTARK

SEQ ID NO: 1401155 - protein, 9 aa, Homo Sapiens
EEFGQLKSG

SEQ ID NO: 1401156 - protein, 9 aa, Homo Sapiens
INAFIWGLA

SEQ ID NO: 1401157 - protein, 9 aa, Homo Sapiens
INPSYLEMT

SEQ ID NO: 1401158 - protein, 9 aa, Homo Sapiens
VTGYVKIHH

SEQ ID NO: 1401159 - protein, 9 aa, Homo Sapiens
MAQRPDGEG

SEQ ID NO: 1401160 - protein, 9 aa, Homo Sapiens
HINCKVNGH

SEQ ID NO: 1401161 - protein, 9 aa, Homo Sapiens
SELKMVTST

SEQ ID NO: 1401162 - protein, 9 aa, Homo Sapiens
FILVPRLEC

SEQ ID NO: 1401163 - protein, 9 aa, Homo Sapiens
HAPARSSSA

SEQ ID NO: 1401164 - protein, 9 aa, Homo Sapiens
EDGPTVPPG

SEQ ID NO: 1401165 - protein, 9 aa, Homo Sapiens
RCQAVVQYM

SEQ ID NO: 1401166 - protein, 9 aa, Homo Sapiens
WRCFSFSGH

SEQ ID NO: 1401167 - protein, 9 aa, Homo Sapiens
WVLSQPQLR

SEQ ID NO: 1401168 - protein, 9 aa, Homo Sapiens
TILAYCSLS

SEQ ID NO: 1401169 - protein, 9 aa, Homo Sapiens
GPSTPSCGT

SEQ ID NO: 1401170 - protein, 9 aa, Homo Sapiens
TGPGKQKRE

SEQ ID NO: 1401171 - protein, 9 aa, Homo Sapiens
EPSKQRGKM

SEQ ID NO: 1401172 - protein, 9 aa, Homo Sapiens
AIVRPVATS

SEQ ID NO: 1401173 - protein, 9 aa, Homo Sapiens
TREEEEGST

SEQ ID NO: 1401174 - protein, 9 aa, Homo Sapiens
KVIPPILLP

SEQ ID NO: 1401175 - protein, 9 aa, Homo Sapiens
SSSKIRTRE

SEQ ID NO: 1401176 - protein, 9 aa, Homo Sapiens
LASCASVAI

SEQ ID NO: 1401177 - protein, 9 aa, Homo Sapiens
PWLPMRSLG

SEQ ID NO: 1401178 - protein, 9 aa, Homo Sapiens
ESKKARSQH

SEQ ID NO: 1401179 - protein, 9 aa, Homo Sapiens
LFLFLLLLT

SEQ ID NO: 1401180 - protein, 9 aa, Homo Sapiens
TGMEHSAPA

SEQ ID NO: 1401181 - protein, 9 aa, Homo Sapiens
PQSPSHEAI

SEQ ID NO: 1401182 - protein, 9 aa, Homo Sapiens
THLRKEKHN

SEQ ID NO: 1401183 - protein, 9 aa, Homo Sapiens
MNYVEHNLK

SEQ ID NO: 1401184 - protein, 9 aa, Homo Sapiens
HSPHLAMAA

SEQ ID NO: 1401185 - protein, 9 aa, Homo Sapiens
WVRFPKDES

SEQ ID NO: 1401186 - protein, 9 aa, Homo Sapiens
HGSQWMVAG

SEQ ID NO: 1401187 - protein, 9 aa, Homo Sapiens
GLHGVDGDG

SEQ ID NO: 1401188 - protein, 9 aa, Homo Sapiens
DKQKKRQQD

SEQ ID NO: 1401189 - protein, 9 aa, Homo Sapiens
VGPPAPPQD

SEQ ID NO: 1401190 - protein, 9 aa, Homo Sapiens
ALCHFTSIK

SEQ ID NO: 1401191 - protein, 9 aa, Homo Sapiens
ETLALVGGE

SEQ ID NO: 1401192 - protein, 9 aa, Homo Sapiens
NKLPNQVKW

SEQ ID NO: 1401193 - protein, 9 aa, Homo Sapiens
GKVVLQVLA

SEQ ID NO: 1401194 - protein, 9 aa, Homo Sapiens
LPTPQPMPP

SEQ ID NO: 1401195 - protein, 9 aa, Homo Sapiens
KKWVLRKAL

SEQ ID NO: 1401196 - protein, 9 aa, Homo Sapiens
AQARVVRCR

SEQ ID NO: 1401197 - protein, 9 aa, Homo Sapiens
LGAVDPQGE

SEQ ID NO: 1401198 - protein, 9 aa, Homo Sapiens
KLKKQFLPP

SEQ ID NO: 1401199 - protein, 9 aa, Homo Sapiens
AVYEKMFPW

SEQ ID NO: 1401200 - protein, 9 aa, Homo Sapiens
CPPPVTPLR

SEQ ID NO: 1401201 - protein, 9 aa, Homo Sapiens
VHLYFCDDH

SEQ ID NO: 1401202 - protein, 9 aa, Homo Sapiens
TAVLVLIGL

SEQ ID NO: 1401203 - protein, 9 aa, Homo Sapiens
LPAALPKKK

SEQ ID NO: 1401204 - protein, 9 aa, Homo Sapiens
PPTPCSRWC

SEQ ID NO: 1401205 - protein, 9 aa, Homo Sapiens
LVASKSQTV

SEQ ID NO: 1401206 - protein, 9 aa, Homo Sapiens
VTFRTARKG

SEQ ID NO: 1401207 - protein, 9 aa, Homo Sapiens
YLPDSCCHH

SEQ ID NO: 1401208 - protein, 9 aa, Homo Sapiens
VAPRCPRSA

SEQ ID NO: 1401209 - protein, 9 aa, Homo Sapiens
LKGVSLVKV

SEQ ID NO: 1401210 - protein, 9 aa, Homo Sapiens
ARATWSKDG

SEQ ID NO: 1401211 - protein, 9 aa, Homo Sapiens
LQGQTGNSK

SEQ ID NO: 1401212 - protein, 9 aa, Homo Sapiens
RERNAKRME

SEQ ID NO: 1401213 - protein, 9 aa, Homo Sapiens
AMCLAQLSE

SEQ ID NO: 1401214 - protein, 9 aa, Homo Sapiens
AVGEPRWAR

SEQ ID NO: 1401215 - protein, 9 aa, Homo Sapiens
PAVAKKTIQ

SEQ ID NO: 1401216 - protein, 9 aa, Homo Sapiens
QDLTSLWLP

SEQ ID NO: 1401217 - protein, 9 aa, Homo Sapiens
RGTVRTQRR

SEQ ID NO: 1401218 - protein, 9 aa, Homo Sapiens
LVLAQEGRF

SEQ ID NO: 1401219 - protein, 9 aa, Homo Sapiens
PHLPGSDPP

SEQ ID NO: 1401220 - protein, 9 aa, Homo Sapiens
SSLQPRPPG

SEQ ID NO: 1401221 - protein, 9 aa, Homo Sapiens
SKVGPWVRF

SEQ ID NO: 1401222 - protein, 9 aa, Homo Sapiens
PGLTHPAHQ

SEQ ID NO: 1401223 - protein, 9 aa, Homo Sapiens
PRTWLSVYS

SEQ ID NO: 1401224 - protein, 9 aa, Homo Sapiens
KLKGVSLVK

SEQ ID NO: 1401225 - protein, 9 aa, Homo Sapiens
FAVLGTMVM

SEQ ID NO: 1401226 - protein, 9 aa, Homo Sapiens
QSGSPIGAF

SEQ ID NO: 1401227 - protein, 9 aa, Homo Sapiens
PYEMFGDEG

SEQ ID NO: 1401228 - protein, 9 aa, Homo Sapiens
IKIALNTPQ

SEQ ID NO: 1401229 - protein, 9 aa, Homo Sapiens
TREAQARVV

SEQ ID NO: 1401230 - protein, 9 aa, Homo Sapiens
WEMNEKKQT

SEQ ID NO: 1401231 - protein, 9 aa, Homo Sapiens
HTNFRFQPQ

SEQ ID NO: 1401232 - protein, 9 aa, Homo Sapiens
RESERDYNM

SEQ ID NO: 1401233 - protein, 9 aa, Homo Sapiens
GHKKAFATC

SEQ ID NO: 1401234 - protein, 9 aa, Homo Sapiens
HLCVQELGL

SEQ ID NO: 1401235 - protein, 9 aa, Homo Sapiens
KLCLTRIRD

SEQ ID NO: 1401236 - protein, 9 aa, Homo Sapiens
AASVRLDSD

SEQ ID NO: 1401237 - protein, 9 aa, Homo Sapiens
IWGLAAQEV

SEQ ID NO: 1401238 - protein, 9 aa, Homo Sapiens
VCPRSRTAS

SEQ ID NO: 1401239 - protein, 9 aa, Homo Sapiens
KLRLFAVLK

SEQ ID NO: 1401240 - protein, 9 aa, Homo Sapiens
EGGNNELIM

SEQ ID NO: 1401241 - protein, 9 aa, Homo Sapiens
GGTPLSISR

SEQ ID NO: 1401242 - protein, 9 aa, Homo Sapiens
KVFERSSAL

SEQ ID NO: 1401243 - protein, 9 aa, Homo Sapiens
HVSFILVSS

SEQ ID NO: 1401244 - protein, 9 aa, Homo Sapiens
AVDCLQAFW

SEQ ID NO: 1401245 - protein, 9 aa, Homo Sapiens
KSQTVGSMT

SEQ ID NO: 1401246 - protein, 9 aa, Homo Sapiens
DGIGSCGDR

SEQ ID NO: 1401247 - protein, 9 aa, Homo Sapiens
RGEKRSKAL

SEQ ID NO: 1401248 - protein, 9 aa, Homo Sapiens
FHSWRKLTI

SEQ ID NO: 1401249 - protein, 9 aa, Homo Sapiens
AIGKLALLG

SEQ ID NO: 1401250 - protein, 9 aa, Homo Sapiens
GISARGSSP

SEQ ID NO: 1401251 - protein, 9 aa, Homo Sapiens
FNEWFEHMN

SEQ ID NO: 1401252 - protein, 9 aa, Homo Sapiens
QASNKKDID

SEQ ID NO: 1401253 - protein, 9 aa, Homo Sapiens
LLLEEPSHL

SEQ ID NO: 1401254 - protein, 9 aa, Homo Sapiens
VFKGSKNLT

SEQ ID NO: 1401255 - protein, 9 aa, Homo Sapiens
PPIFHSGML

SEQ ID NO: 1401256 - protein, 9 aa, Homo Sapiens
HTELNAIMN

SEQ ID NO: 1401257 - protein, 9 aa, Homo Sapiens
GSSHLPTLA

SEQ ID NO: 1401258 - protein, 9 aa, Homo Sapiens
GMSTLLISK

SEQ ID NO: 1401259 - protein, 9 aa, Homo Sapiens
IHDSLTNCT

SEQ ID NO: 1401260 - protein, 9 aa, Homo Sapiens
KQIHLHLTP

SEQ ID NO: 1401261 - protein, 9 aa, Homo Sapiens
STPSCGTTT

SEQ ID NO: 1401262 - protein, 9 aa, Homo Sapiens
LCQSLGNSL

SEQ ID NO: 1401263 - protein, 9 aa, Homo Sapiens
RVVHITMSY

SEQ ID NO: 1401264 - protein, 9 aa, Homo Sapiens
HRLRVLYRI

SEQ ID NO: 1401265 - protein, 9 aa, Homo Sapiens
MEKLAVLKD

SEQ ID NO: 1401266 - protein, 9 aa, Homo Sapiens
KGSAKPSAT

SEQ ID NO: 1401267 - protein, 9 aa, Homo Sapiens
QQSNSCPEV

SEQ ID NO: 1401268 - protein, 9 aa, Homo Sapiens
IVMGSDSRV

SEQ ID NO: 1401269 - protein, 9 aa, Homo Sapiens
TSVEELQGG

SEQ ID NO: 1401270 - protein, 9 aa, Homo Sapiens
CRSNRCRIG

SEQ ID NO: 1401271 - protein, 9 aa, Homo Sapiens
LTNQLMGLA

SEQ ID NO: 1401272 - protein, 9 aa, Homo Sapiens
LLAFESHHQ

SEQ ID NO: 1401273 - protein, 9 aa, Homo Sapiens
FLNPVLEMM

SEQ ID NO: 1401274 - protein, 9 aa, Homo Sapiens
GAEREHHSC

SEQ ID NO: 1401275 - protein, 9 aa, Homo Sapiens
YVRDIKIQI

SEQ ID NO: 1401276 - protein, 9 aa, Homo Sapiens
QVNPVVPDY

SEQ ID NO: 1401277 - protein, 9 aa, Homo Sapiens
GQFPNIKSR

SEQ ID NO: 1401278 - protein, 9 aa, Homo Sapiens
RTPALTSLP

SEQ ID NO: 1401279 - protein, 9 aa, Homo Sapiens
NSRTQQSNS

SEQ ID NO: 1401280 - protein, 9 aa, Homo Sapiens
MGGMSRTPP

SEQ ID NO: 1401281 - protein, 9 aa, Homo Sapiens
EAGRFAVLG

SEQ ID NO: 1401282 - protein, 9 aa, Homo Sapiens
AARGLEATT

SEQ ID NO: 1401283 - protein, 9 aa, Homo Sapiens
MTRLHVTWS

SEQ ID NO: 1401284 - protein, 9 aa, Homo Sapiens
ASTRPQDGN

SEQ ID NO: 1401285 - protein, 9 aa, Homo Sapiens
SPIGAFSLR

SEQ ID NO: 1401286 - protein, 9 aa, Homo Sapiens
LIFADNSGM

SEQ ID NO: 1401287 - protein, 9 aa, Homo Sapiens
AVLKQLSPV

SEQ ID NO: 1401288 - protein, 9 aa, Homo Sapiens
AAADAAAAV

SEQ ID NO: 1401289 - protein, 9 aa, Homo Sapiens
HISESPSTK

SEQ ID NO: 1401290 - protein, 9 aa, Homo Sapiens
GPGLQGSPH

SEQ ID NO: 1401291 - protein, 9 aa, Homo Sapiens
CSKVLGTDS

SEQ ID NO: 1401292 - protein, 9 aa, Homo Sapiens
NIPNMDTGE

SEQ ID NO: 1401293 - protein, 9 aa, Homo Sapiens
LCSIIGGTD

SEQ ID NO: 1401294 - protein, 9 aa, Homo Sapiens
CKECGEMFR

SEQ ID NO: 1401295 - protein, 9 aa, Homo Sapiens
HPSVEEIKL

SEQ ID NO: 1401296 - protein, 9 aa, Homo Sapiens
DENYMIAMC

SEQ ID NO: 1401297 - protein, 9 aa, Homo Sapiens
PYEFNVCGK

SEQ ID NO: 1401298 - protein, 9 aa, Homo Sapiens
THLDRLVAF

SEQ ID NO: 1401299 - protein, 9 aa, Homo Sapiens
PGRNYYGNS

SEQ ID NO: 1401300 - protein, 9 aa, Homo Sapiens
LAQAIAVQA

SEQ ID NO: 1401301 - protein, 9 aa, Homo Sapiens
KILVAFLVA

SEQ ID NO: 1401302 - protein, 9 aa, Homo Sapiens
LLYTESKKA

SEQ ID NO: 1401303 - protein, 9 aa, Homo Sapiens
LALSGLPGL

SEQ ID NO: 1401304 - protein, 9 aa, Homo Sapiens
CSRWCSGWA

SEQ ID NO: 1401305 - protein, 9 aa, Homo Sapiens
EKKAQDVEP

SEQ ID NO: 1401306 - protein, 9 aa, Homo Sapiens
LGRVSAPEA

SEQ ID NO: 1401307 - protein, 9 aa, Homo Sapiens
KQVLAGHGA

SEQ ID NO: 1401308 - protein, 9 aa, Homo Sapiens
RLLCSIIGG

SEQ ID NO: 1401309 - protein, 9 aa, Homo Sapiens
VVCGSFARG

SEQ ID NO: 1401310 - protein, 9 aa, Homo Sapiens
PWRNQASNK

SEQ ID NO: 1401311 - protein, 9 aa, Homo Sapiens
AWAAAPTPT

SEQ ID NO: 1401312 - protein, 9 aa, Homo Sapiens
KHNADYDLS

SEQ ID NO: 1401313 - protein, 9 aa, Homo Sapiens
PFMTHSIIA

SEQ ID NO: 1401314 - protein, 9 aa, Homo Sapiens
GTPDIHSSG

SEQ ID NO: 1401315 - protein, 9 aa, Homo Sapiens
WRIGGGTPL

SEQ ID NO: 1401316 - protein, 9 aa, Homo Sapiens
PTMWLSFSL

SEQ ID NO: 1401317 - protein, 9 aa, Homo Sapiens
AVNKSGTQR

SEQ ID NO: 1401318 - protein, 9 aa, Homo Sapiens
FGDEGVMCL

SEQ ID NO: 1401319 - protein, 9 aa, Homo Sapiens
DQSESSLSS

SEQ ID NO: 1401320 - protein, 9 aa, Homo Sapiens
RTHSTFEDF

SEQ ID NO: 1401321 - protein, 9 aa, Homo Sapiens
NVVTNHLLY

SEQ ID NO: 1401322 - protein, 9 aa, Homo Sapiens
VGCCHTFGK

SEQ ID NO: 1401323 - protein, 9 aa, Homo Sapiens
QEKEGIVKN

SEQ ID NO: 1401324 - protein, 9 aa, Homo Sapiens
PIGAFSLRD

SEQ ID NO: 1401325 - protein, 9 aa, Homo Sapiens
GSAKPSATS

SEQ ID NO: 1401326 - protein, 9 aa, Homo Sapiens
GATVILLYT

SEQ ID NO: 1401327 - protein, 9 aa, Homo Sapiens
YYFRIASSV

SEQ ID NO: 1401328 - protein, 9 aa, Homo Sapiens
ASFSPNFAQ

SEQ ID NO: 1401329 - protein, 9 aa, Homo Sapiens
PQNIKIQKS

SEQ ID NO: 1401330 - protein, 9 aa, Homo Sapiens
MVRIAPEER

SEQ ID NO: 1401331 - protein, 9 aa, Homo Sapiens
LTYNIANNK

SEQ ID NO: 1401332 - protein, 9 aa, Homo Sapiens
YFLVKRPSL

SEQ ID NO: 1401333 - protein, 9 aa, Homo Sapiens
KNKENIFVS

SEQ ID NO: 1401334 - protein, 9 aa, Homo Sapiens
GARHHTREI

SEQ ID NO: 1401335 - protein, 9 aa, Homo Sapiens
AVCDIPPQG

SEQ ID NO: 1401336 - protein, 9 aa, Homo Sapiens
LMSPNRGVL

SEQ ID NO: 1401337 - protein, 9 aa, Homo Sapiens
MYRGLWLMS

SEQ ID NO: 1401338 - protein, 9 aa, Homo Sapiens
KKVITVYVE

SEQ ID NO: 1401339 - protein, 9 aa, Homo Sapiens
VGCVPFLEI

SEQ ID NO: 1401340 - protein, 9 aa, Homo Sapiens
VDISPGPTS

SEQ ID NO: 1401341 - protein, 9 aa, Homo Sapiens
CQNEFVMCR

SEQ ID NO: 1401342 - protein, 9 aa, Homo Sapiens
HQMKCLTAV

SEQ ID NO: 1401343 - protein, 9 aa, Homo Sapiens
MMFWLIKPQ

SEQ ID NO: 1401344 - protein, 9 aa, Homo Sapiens
AVPIVISLT

SEQ ID NO: 1401345 - protein, 9 aa, Homo Sapiens
NSKPMEDKD

SEQ ID NO: 1401346 - protein, 9 aa, Homo Sapiens
IALNTPQLA

SEQ ID NO: 1401347 - protein, 9 aa, Homo Sapiens
SLVKVKFED

SEQ ID NO: 1401348 - protein, 9 aa, Homo Sapiens
ISLVIFYSL

SEQ ID NO: 1401349 - protein, 9 aa, Homo Sapiens
KLLCRQMLP

SEQ ID NO: 1401350 - protein, 9 aa, Homo Sapiens
RVLLDQFSA

SEQ ID NO: 1401351 - protein, 9 aa, Homo Sapiens
PNPRKSVVP

SEQ ID NO: 1401352 - protein, 9 aa, Homo Sapiens
RFAVLGTMV

SEQ ID NO: 1401353 - protein, 9 aa, Homo Sapiens
EQHTKAVGC

SEQ ID NO: 1401354 - protein, 9 aa, Homo Sapiens
TIGVKINEK

SEQ ID NO: 1401355 - protein, 9 aa, Homo Sapiens
RIYKDYIWE

SEQ ID NO: 1401356 - protein, 9 aa, Homo Sapiens
MEMHYGHQA

SEQ ID NO: 1401357 - protein, 9 aa, Homo Sapiens
MAASGKGSA

SEQ ID NO: 1401358 - protein, 9 aa, Homo Sapiens
YKDYIWERF

SEQ ID NO: 1401359 - protein, 9 aa, Homo Sapiens
NTRILGRVS

SEQ ID NO: 1401360 - protein, 9 aa, Homo Sapiens
KRPCKSKSC

SEQ ID NO: 1401361 - protein, 9 aa, Homo Sapiens
ITHLRKEKH

SEQ ID NO: 1401362 - protein, 9 aa, Homo Sapiens
NEFLFHRWG

SEQ ID NO: 1401363 - protein, 9 aa, Homo Sapiens
RMPQFSLGW

SEQ ID NO: 1401364 - protein, 9 aa, Homo Sapiens
ETVTIKIAL

SEQ ID NO: 1401365 - protein, 9 aa, Homo Sapiens
SSRKDGCYW

SEQ ID NO: 1401366 - protein, 9 aa, Homo Sapiens
SRTQQSNSC

SEQ ID NO: 1401367 - protein, 9 aa, Homo Sapiens
CHNSKLTKV

SEQ ID NO: 1401368 - protein, 9 aa, Homo Sapiens
QGGAAQLNV

SEQ ID NO: 1401369 - protein, 9 aa, Homo Sapiens
DGKWEQKKF

SEQ ID NO: 1401370 - protein, 9 aa, Homo Sapiens
NHKVVNHSN

SEQ ID NO: 1401371 - protein, 9 aa, Homo Sapiens
CCKPVCSVP

SEQ ID NO: 1401372 - protein, 9 aa, Homo Sapiens
HHSCTPVPV

SEQ ID NO: 1401373 - protein, 9 aa, Homo Sapiens
ILRRSSLGR

SEQ ID NO: 1401374 - protein, 9 aa, Homo Sapiens
RIGFSLAKT

SEQ ID NO: 1401375 - protein, 9 aa, Homo Sapiens
HRYLSLCIR

SEQ ID NO: 1401376 - protein, 9 aa, Homo Sapiens
AEKKAQDVE

SEQ ID NO: 1401377 - protein, 9 aa, Homo Sapiens
NNSKPMEDK

SEQ ID NO: 1401378 - protein, 9 aa, Homo Sapiens
STVYDMQAL

SEQ ID NO: 1401379 - protein, 9 aa, Homo Sapiens
FECKECGEM

SEQ ID NO: 1401380 - protein, 9 aa, Homo Sapiens
RHDPPDLAP

SEQ ID NO: 1401381 - protein, 9 aa, Homo Sapiens
IQNIEQQKP

SEQ ID NO: 1401382 - protein, 9 aa, Homo Sapiens
ECKECGEMF

SEQ ID NO: 1401383 - protein, 9 aa, Homo Sapiens
GRLLGSLEE

SEQ ID NO: 1401384 - protein, 9 aa, Homo Sapiens
NFHRDLFLH

SEQ ID NO: 1401385 - protein, 9 aa, Homo Sapiens
VLGTDSSLQ

SEQ ID NO: 1401386 - protein, 9 aa, Homo Sapiens
LEILRRSSL

SEQ ID NO: 1401387 - protein, 9 aa, Homo Sapiens
FPPLRRLII

SEQ ID NO: 1401388 - protein, 9 aa, Homo Sapiens
QGLWRKVQS

SEQ ID NO: 1401389 - protein, 9 aa, Homo Sapiens
PHEIQEKLC

SEQ ID NO: 1401390 - protein, 9 aa, Homo Sapiens
PPQNGQNPQ

SEQ ID NO: 1401391 - protein, 9 aa, Homo Sapiens
RKSSRGTVR

SEQ ID NO: 1401392 - protein, 9 aa, Homo Sapiens
AISKEIIAP

SEQ ID NO: 1401393 - protein, 9 aa, Homo Sapiens
WHRVGEVVQ

SEQ ID NO: 1401394 - protein, 9 aa, Homo Sapiens
CTFFFLHKE

SEQ ID NO: 1401395 - protein, 9 aa, Homo Sapiens
KQTAISQHA

SEQ ID NO: 1401396 - protein, 9 aa, Homo Sapiens
MLPLEIALT

SEQ ID NO: 1401397 - protein, 9 aa, Homo Sapiens
RVATELNIR

SEQ ID NO: 1401398 - protein, 9 aa, Homo Sapiens
NIKIQKSQG

SEQ ID NO: 1401399 - protein, 9 aa, Homo Sapiens
EVQCTPQPC

SEQ ID NO: 1401400 - protein, 9 aa, Homo Sapiens
AKRMESILQ

SEQ ID NO: 1401401 - protein, 9 aa, Homo Sapiens
RDGWGGLWL

SEQ ID NO: 1401402 - protein, 9 aa, Homo Sapiens
INVVTNHLL

SEQ ID NO: 1401403 - protein, 9 aa, Homo Sapiens
SRKDGCYWC

SEQ ID NO: 1401404 - protein, 9 aa, Homo Sapiens
HQEAATKPL

SEQ ID NO: 1401405 - protein, 9 aa, Homo Sapiens
YISLVIFYS

SEQ ID NO: 1401406 - protein, 9 aa, Homo Sapiens
ELIEEFGQL

SEQ ID NO: 1401407 - protein, 9 aa, Homo Sapiens
GKHIGKVVL

SEQ ID NO: 1401408 - protein, 9 aa, Homo Sapiens
LPRRRSTEG

SEQ ID NO: 1401409 - protein, 9 aa, Homo Sapiens
LPALKIFAT

SEQ ID NO: 1401410 - protein, 9 aa, Homo Sapiens
VLRSLAAWD

SEQ ID NO: 1401411 - protein, 9 aa, Homo Sapiens
KVVKKASGL

SEQ ID NO: 1401412 - protein, 9 aa, Homo Sapiens
TGNMALAAI

SEQ ID NO: 1401413 - protein, 9 aa, Homo Sapiens
CPLKHHSHQ

SEQ ID NO: 1401414 - protein, 9 aa, Homo Sapiens
TKHHWLILE

SEQ ID NO: 1401415 - protein, 9 aa, Homo Sapiens
SGMSTLLIS

SEQ ID NO: 1401416 - protein, 9 aa, Homo Sapiens
AEAGRRANT

SEQ ID NO: 1401417 - protein, 9 aa, Homo Sapiens
RAGFQWGES

SEQ ID NO: 1401418 - protein, 9 aa, Homo Sapiens
PGSSHLPTL

SEQ ID NO: 1401419 - protein, 9 aa, Homo Sapiens
NAGGQQERD

SEQ ID NO: 1401420 - protein, 9 aa, Homo Sapiens
CPYMAFVQF

SEQ ID NO: 1401421 - protein, 9 aa, Homo Sapiens
EFVITLISV

SEQ ID NO: 1401422 - protein, 9 aa, Homo Sapiens
LSKSSGCTY

SEQ ID NO: 1401423 - protein, 9 aa, Homo Sapiens
TGYNASRDV

SEQ ID NO: 1401424 - protein, 9 aa, Homo Sapiens
GVCHHITGE

SEQ ID NO: 1401425 - protein, 9 aa, Homo Sapiens
KQLSPVRAF

SEQ ID NO: 1401426 - protein, 9 aa, Homo Sapiens
DGRVDQPLH

SEQ ID NO: 1401427 - protein, 9 aa, Homo Sapiens
RFIRCLMTH

SEQ ID NO: 1401428 - protein, 9 aa, Homo Sapiens
LQGTTEPFM

SEQ ID NO: 1401429 - protein, 9 aa, Homo Sapiens
QLKETRISF

SEQ ID NO: 1401430 - protein, 9 aa, Homo Sapiens
PQVNPVVPD

SEQ ID NO: 1401431 - protein, 9 aa, Homo Sapiens
EHEGNFGAV

SEQ ID NO: 1401432 - protein, 9 aa, Homo Sapiens
PFFFILVPR

SEQ ID NO: 1401433 - protein, 9 aa, Homo Sapiens
GWHRVGEVV

SEQ ID NO: 1401434 - protein, 9 aa, Homo Sapiens
SVGTTSDIL

SEQ ID NO: 1401435 - protein, 9 aa, Homo Sapiens
VVFCQLCSW

SEQ ID NO: 1401436 - protein, 9 aa, Homo Sapiens
SHRDVPGSK

SEQ ID NO: 1401437 - protein, 9 aa, Homo Sapiens
RELFVLGTA

SEQ ID NO: 1401438 - protein, 9 aa, Homo Sapiens
MLPKLLCRQ

SEQ ID NO: 1401439 - protein, 9 aa, Homo Sapiens
MGLSSLWES

SEQ ID NO: 1401440 - protein, 9 aa, Homo Sapiens
GRSWKLLNY

SEQ ID NO: 1401441 - protein, 9 aa, Homo Sapiens
PSCHQHLCN

SEQ ID NO: 1401442 - protein, 9 aa, Homo Sapiens
AEREHHSCT

SEQ ID NO: 1401443 - protein, 9 aa, Homo Sapiens
WISGSEATS

SEQ ID NO: 1401444 - protein, 9 aa, Homo Sapiens
RLEIYRNKN

SEQ ID NO: 1401445 - protein, 9 aa, Homo Sapiens
PAFGGAEGQ

SEQ ID NO: 1401446 - protein, 9 aa, Homo Sapiens
SDDPMLPSH

SEQ ID NO: 1401447 - protein, 9 aa, Homo Sapiens
GIVMGSDSR

SEQ ID NO: 1401448 - protein, 9 aa, Homo Sapiens
DGKITWQEF

SEQ ID NO: 1401449 - protein, 9 aa, Homo Sapiens
EIPLLFTAT

SEQ ID NO: 1401450 - protein, 9 aa, Homo Sapiens
RPSWCPPGT

SEQ ID NO: 1401451 - protein, 9 aa, Homo Sapiens
PKEKSKHGL

SEQ ID NO: 1401452 - protein, 9 aa, Homo Sapiens
HKKAFATCA

SEQ ID NO: 1401453 - protein, 9 aa, Homo Sapiens
RPESSLTWR

SEQ ID NO: 1401454 - protein, 9 aa, Homo Sapiens
RALFLEVIL

SEQ ID NO: 1401455 - protein, 9 aa, Homo Sapiens
LSHRSLYFG

SEQ ID NO: 1401456 - protein, 9 aa, Homo Sapiens
AETLALVGG

SEQ ID NO: 1401457 - protein, 9 aa, Homo Sapiens
RTRWTTAAA

SEQ ID NO: 1401458 - protein, 9 aa, Homo Sapiens
QPMPPCSPS

SEQ ID NO: 1401459 - protein, 9 aa, Homo Sapiens
VYHRRLHAL

SEQ ID NO: 1401460 - protein, 9 aa, Homo Sapiens
SGLPGLFDC

SEQ ID NO: 1401461 - protein, 9 aa, Homo Sapiens
WKLLNYQME

SEQ ID NO: 1401462 - protein, 9 aa, Homo Sapiens
SNNSKPMED

SEQ ID NO: 1401463 - protein, 9 aa, Homo Sapiens
IGATVILLY

SEQ ID NO: 1401464 - protein, 9 aa, Homo Sapiens
IVRPVATSV

SEQ ID NO: 1401465 - protein, 9 aa, Homo Sapiens
VKRPSLHRY

SEQ ID NO: 1401466 - protein, 9 aa, Homo Sapiens
SLWALPVSP

SEQ ID NO: 1401467 - protein, 9 aa, Homo Sapiens
GNWGHLDRV

SEQ ID NO: 1401468 - protein, 9 aa, Homo Sapiens
RGHPSAFNN

SEQ ID NO: 1401469 - protein, 9 aa, Homo Sapiens
SSEISQGTE

SEQ ID NO: 1401470 - protein, 9 aa, Homo Sapiens
TAIQSHKLL

SEQ ID NO: 1401471 - protein, 9 aa, Homo Sapiens
DIVTVVAGL

SEQ ID NO: 1401472 - protein, 9 aa, Homo Sapiens
GDEGVMCLN

SEQ ID NO: 1401473 - protein, 9 aa, Homo Sapiens
SLPPHEDYE

SEQ ID NO: 1401474 - protein, 9 aa, Homo Sapiens
SGNSWQVHL

SEQ ID NO: 1401475 - protein, 9 aa, Homo Sapiens
KDGKWEQKK

SEQ ID NO: 1401476 - protein, 9 aa, Homo Sapiens
WCRSNRCRI

SEQ ID NO: 1401477 - protein, 9 aa, Homo Sapiens
EQPEELTNT

SEQ ID NO: 1401478 - protein, 9 aa, Homo Sapiens
RCPRSAVDI

SEQ ID NO: 1401479 - protein, 9 aa, Homo Sapiens
SKSSLRVAT

SEQ ID NO: 1401480 - protein, 9 aa, Homo Sapiens
GAIVRPVAT

SEQ ID NO: 1401481 - protein, 9 aa, Homo Sapiens
HEAKPHSCP

SEQ ID NO: 1401482 - protein, 9 aa, Homo Sapiens
WLSVYSAPG

SEQ ID NO: 1401483 - protein, 9 aa, Homo Sapiens
AARWSARSR

SEQ ID NO: 1401484 - protein, 9 aa, Homo Sapiens
LRVQSVLLL

SEQ ID NO: 1401485 - protein, 9 aa, Homo Sapiens
MANNFTQDT

SEQ ID NO: 1401486 - protein, 9 aa, Homo Sapiens
GRLVIVGHG

SEQ ID NO: 1401487 - protein, 9 aa, Homo Sapiens
KEGIVKNLF

SEQ ID NO: 1401488 - protein, 9 aa, Homo Sapiens
HKYMQKEGC

SEQ ID NO: 1401489 - protein, 9 aa, Homo Sapiens
GSNKSPASA

SEQ ID NO: 1401490 - protein, 9 aa, Homo Sapiens
ETTTLPGST

SEQ ID NO: 1401491 - protein, 9 aa, Homo Sapiens
HPQEILRDS

SEQ ID NO: 1401492 - protein, 9 aa, Homo Sapiens
AYCSLSFPG

SEQ ID NO: 1401493 - protein, 9 aa, Homo Sapiens
PSPRVAHAC

SEQ ID NO: 1401494 - protein, 9 aa, Homo Sapiens
GPSQVGGRL

SEQ ID NO: 1401495 - protein, 9 aa, Homo Sapiens
CLWVVPGAL

SEQ ID NO: 1401496 - protein, 9 aa, Homo Sapiens
GAPALSWFP

SEQ ID NO: 1401497 - protein, 9 aa, Homo Sapiens
NIEQQKPNW

SEQ ID NO: 1401498 - protein, 9 aa, Homo Sapiens
FFQRNHYFR

SEQ ID NO: 1401499 - protein, 9 aa, Homo Sapiens
LSGRLAWVE

SEQ ID NO: 1401500 - protein, 9 aa, Homo Sapiens
DIDEYKKTY

SEQ ID NO: 1401501 - protein, 9 aa, Homo Sapiens
GPSLWALPV

SEQ ID NO: 1401502 - protein, 9 aa, Homo Sapiens
QHQLQKPPP

SEQ ID NO: 1401503 - protein, 9 aa, Homo Sapiens
EELEALKQM

SEQ ID NO: 1401504 - protein, 9 aa, Homo Sapiens
ASASRPSRP

SEQ ID NO: 1401505 - protein, 9 aa, Homo Sapiens
SCTPVPVAC

SEQ ID NO: 1401506 - protein, 9 aa, Homo Sapiens
HDTVTFRTA

SEQ ID NO: 1401507 - protein, 9 aa, Homo Sapiens
HTAAENDFV

SEQ ID NO: 1401508 - protein, 9 aa, Homo Sapiens
VNRLQSQRA

SEQ ID NO: 1401509 - protein, 9 aa, Homo Sapiens
MTVSGASIW

SEQ ID NO: 1401510 - protein, 9 aa, Homo Sapiens
VKYNDKHIH

SEQ ID NO: 1401511 - protein, 9 aa, Homo Sapiens
SRLVGLTDE

SEQ ID NO: 1401512 - protein, 9 aa, Homo Sapiens
STFEDFPQS

SEQ ID NO: 1401513 - protein, 9 aa, Homo Sapiens
VAFLVALTI

SEQ ID NO: 1401514 - protein, 9 aa, Homo Sapiens
PCKSKSCLR

SEQ ID NO: 1401515 - protein, 9 aa, Homo Sapiens
CRPCCRPAC

SEQ ID NO: 1401516 - protein, 9 aa, Homo Sapiens
PLGTSPVKG

SEQ ID NO: 1401517 - protein, 9 aa, Homo Sapiens
VAIVCTGYN

SEQ ID NO: 1401518 - protein, 9 aa, Homo Sapiens
TEKEDNSNI

SEQ ID NO: 1401519 - protein, 9 aa, Homo Sapiens
FDPNTYLPD

SEQ ID NO: 1401520 - protein, 9 aa, Homo Sapiens
ITVEHPDMK

SEQ ID NO: 1401521 - protein, 9 aa, Homo Sapiens
FMVETLCIC

SEQ ID NO: 1401522 - protein, 9 aa, Homo Sapiens
EDPFHSWRK

SEQ ID NO: 1401523 - protein, 9 aa, Homo Sapiens
ARFIVVFLF

SEQ ID NO: 1401524 - protein, 9 aa, Homo Sapiens
DTSKHIKEN

SEQ ID NO: 1401525 - protein, 9 aa, Homo Sapiens
VELESRLVG

SEQ ID NO: 1401526 - protein, 9 aa, Homo Sapiens
REREQFLVA

SEQ ID NO: 1401527 - protein, 9 aa, Homo Sapiens
IAMCLAQLS

SEQ ID NO: 1401528 - protein, 9 aa, Homo Sapiens
QARRKQQEE

SEQ ID NO: 1401529 - protein, 9 aa, Homo Sapiens
PVTPLRVQS

SEQ ID NO: 1401530 - protein, 9 aa, Homo Sapiens
PRVVHITMS

SEQ ID NO: 1401531 - protein, 9 aa, Homo Sapiens
HLHLTPTQI

SEQ ID NO: 1401532 - protein, 9 aa, Homo Sapiens
GIKKVITVY

SEQ ID NO: 1401533 - protein, 9 aa, Homo Sapiens
CRRKKKVRS

SEQ ID NO: 1401534 - protein, 9 aa, Homo Sapiens
RCPSKKSTR

SEQ ID NO: 1401535 - protein, 9 aa, Homo Sapiens
VCCKPVCSV

SEQ ID NO: 1401536 - protein, 9 aa, Homo Sapiens
RHHTREIFV

SEQ ID NO: 1401537 - protein, 9 aa, Homo Sapiens
KVKQPPLLL

SEQ ID NO: 1401538 - protein, 9 aa, Homo Sapiens
ADAAAAVAW

SEQ ID NO: 1401539 - protein, 9 aa, Homo Sapiens
TPALTSLPG

SEQ ID NO: 1401540 - protein, 9 aa, Homo Sapiens
GAIHAKYDV

SEQ ID NO: 1401541 - protein, 9 aa, Homo Sapiens
GKAPSPRVA

SEQ ID NO: 1401542 - protein, 9 aa, Homo Sapiens
SRARTRWTT

SEQ ID NO: 1401543 - protein, 9 aa, Homo Sapiens
QEVARWVVF

SEQ ID NO: 1401544 - protein, 9 aa, Homo Sapiens
NLRPNIPNR

SEQ ID NO: 1401545 - protein, 9 aa, Homo Sapiens
EPRSRRPRF

SEQ ID NO: 1401546 - protein, 9 aa, Homo Sapiens
MPFIVSMRY

SEQ ID NO: 1401547 - protein, 9 aa, Homo Sapiens
TMEDPGVRD

SEQ ID NO: 1401548 - protein, 9 aa, Homo Sapiens
PESSLTWRV

SEQ ID NO: 1401549 - protein, 9 aa, Homo Sapiens
GTKNSCSRT

SEQ ID NO: 1401550 - protein, 9 aa, Homo Sapiens
HSCTPVPVA

SEQ ID NO: 1401551 - protein, 9 aa, Homo Sapiens
ATNVHPGVT

SEQ ID NO: 1401552 - protein, 9 aa, Homo Sapiens
ASSQQQAPL

SEQ ID NO: 1401553 - protein, 9 aa, Homo Sapiens
SFPGSSHLP

SEQ ID NO: 1401554 - protein, 9 aa, Homo Sapiens
KGHRRKEIW

SEQ ID NO: 1401555 - protein, 9 aa, Homo Sapiens
KCQIWSIVH

SEQ ID NO: 1401556 - protein, 9 aa, Homo Sapiens
AELRGMMSE

SEQ ID NO: 1401557 - protein, 9 aa, Homo Sapiens
LQRMTRLHV

SEQ ID NO: 1401558 - protein, 9 aa, Homo Sapiens
VEVHDQDRK

SEQ ID NO: 1401559 - protein, 9 aa, Homo Sapiens
EDADVICSG

SEQ ID NO: 1401560 - protein, 9 aa, Homo Sapiens
GAALFGDKP

SEQ ID NO: 1401561 - protein, 9 aa, Homo Sapiens
EQFLVASLH

SEQ ID NO: 1401562 - protein, 9 aa, Homo Sapiens
MSPQNIGAG

SEQ ID NO: 1401563 - protein, 9 aa, Homo Sapiens
AQVYFFHFL

SEQ ID NO: 1401564 - protein, 9 aa, Homo Sapiens
VDVMKLLLF

SEQ ID NO: 1401565 - protein, 9 aa, Homo Sapiens
PWVRFPKDE

SEQ ID NO: 1401566 - protein, 9 aa, Homo Sapiens
AIAVQAGDG

SEQ ID NO: 1401567 - protein, 9 aa, Homo Sapiens
QLKSGDAAA

SEQ ID NO: 1401568 - protein, 9 aa, Homo Sapiens
HKYYENCEV

SEQ ID NO: 1401569 - protein, 9 aa, Homo Sapiens
HGVINMGNS

SEQ ID NO: 1401570 - protein, 9 aa, Homo Sapiens
RDCRDNRER

SEQ ID NO: 1401571 - protein, 9 aa, Homo Sapiens
LNAVDNLVV

SEQ ID NO: 1401572 - protein, 9 aa, Homo Sapiens
HWLILESIC

SEQ ID NO: 1401573 - protein, 9 aa, Homo Sapiens
GDLYPLFAY

SEQ ID NO: 1401574 - protein, 9 aa, Homo Sapiens
VSAPEASHD

SEQ ID NO: 1401575 - protein, 9 aa, Homo Sapiens
TSLWLPRRR

SEQ ID NO: 1401576 - protein, 9 aa, Homo Sapiens
HTKAVGCCH

SEQ ID NO: 1401577 - protein, 9 aa, Homo Sapiens
PFLGPIIFS

SEQ ID NO: 1401578 - protein, 9 aa, Homo Sapiens
LEVLIEDLE

SEQ ID NO: 1401579 - protein, 9 aa, Homo Sapiens
KSCLRALFL

SEQ ID NO: 1401580 - protein, 9 aa, Homo Sapiens
STSPVSKKA

SEQ ID NO: 1401581 - protein, 9 aa, Homo Sapiens
IGGSTDTSK

SEQ ID NO: 1401582 - protein, 9 aa, Homo Sapiens
APQLVIKED

SEQ ID NO: 1401583 - protein, 9 aa, Homo Sapiens
YLPCPIHQV

SEQ ID NO: 1401584 - protein, 9 aa, Homo Sapiens
VLLLGVPQT

SEQ ID NO: 1401585 - protein, 9 aa, Homo Sapiens
HEAETLALV

SEQ ID NO: 1401586 - protein, 9 aa, Homo Sapiens
VWHVWTTLS

SEQ ID NO: 1401587 - protein, 9 aa, Homo Sapiens
VQCTPQPCP

SEQ ID NO: 1401588 - protein, 9 aa, Homo Sapiens
QEERLQQLQ

SEQ ID NO: 1401589 - protein, 9 aa, Homo Sapiens
SATPAPLLA

SEQ ID NO: 1401590 - protein, 9 aa, Homo Sapiens
FILPWRNQA

SEQ ID NO: 1401591 - protein, 9 aa, Homo Sapiens
PEDERLCAN

SEQ ID NO: 1401592 - protein, 9 aa, Homo Sapiens
SKPMEDKDA

SEQ ID NO: 1401593 - protein, 9 aa, Homo Sapiens
DSLNHSLHI

SEQ ID NO: 1401594 - protein, 9 aa, Homo Sapiens
GGSTDTSKH

SEQ ID NO: 1401595 - protein, 9 aa, Homo Sapiens
PLQSVPPSQ

SEQ ID NO: 1401596 - protein, 9 aa, Homo Sapiens
AFNNLKNCI

SEQ ID NO: 1401597 - protein, 9 aa, Homo Sapiens
GRHCFEARI

SEQ ID NO: 1401598 - protein, 9 aa, Homo Sapiens
EMNEKKQTE

SEQ ID NO: 1401599 - protein, 9 aa, Homo Sapiens
PMPPCSPSS

SEQ ID NO: 1401600 - protein, 9 aa, Homo Sapiens
DSLPPHEDY

SEQ ID NO: 1401601 - protein, 9 aa, Homo Sapiens
YVEHNLKSL

SEQ ID NO: 1401602 - protein, 9 aa, Homo Sapiens
VDQPLHSGL

SEQ ID NO: 1401603 - protein, 9 aa, Homo Sapiens
FRGPSQVGG

SEQ ID NO: 1401604 - protein, 9 aa, Homo Sapiens
VKAELHILD

SEQ ID NO: 1401605 - protein, 9 aa, Homo Sapiens
MSTCYHQAA

SEQ ID NO: 1401606 - protein, 9 aa, Homo Sapiens
DSLTNCTFV

SEQ ID NO: 1401607 - protein, 9 aa, Homo Sapiens
TMGFKINFL

SEQ ID NO: 1401608 - protein, 9 aa, Homo Sapiens
EGDLQHALA

SEQ ID NO: 1401609 - protein, 9 aa, Homo Sapiens
NSNREVALQ

SEQ ID NO: 1401610 - protein, 9 aa, Homo Sapiens
FIQPNSREE

SEQ ID NO: 1401611 - protein, 9 aa, Homo Sapiens
HNLKSLMET

SEQ ID NO: 1401612 - protein, 9 aa, Homo Sapiens
SISRPTSRA

SEQ ID NO: 1401613 - protein, 9 aa, Homo Sapiens
EITVEHPDM

SEQ ID NO: 1401614 - protein, 9 aa, Homo Sapiens
RVVPVHLVL

SEQ ID NO: 1401615 - protein, 9 aa, Homo Sapiens
SLVIFYSLI

SEQ ID NO: 1401616 - protein, 9 aa, Homo Sapiens
QIRKRPCKS

SEQ ID NO: 1401617 - protein, 9 aa, Homo Sapiens
LSAENVPCI

SEQ ID NO: 1401618 - protein, 9 aa, Homo Sapiens
SEDADVICS

SEQ ID NO: 1401619 - protein, 9 aa, Homo Sapiens
GGGTGSGMS

SEQ ID NO: 1401620 - protein, 9 aa, Homo Sapiens
SCPEVATPK

SEQ ID NO: 1401621 - protein, 9 aa, Homo Sapiens
LPASWFLSV

SEQ ID NO: 1401622 - protein, 9 aa, Homo Sapiens
CQVTAIGAT

SEQ ID NO: 1401623 - protein, 9 aa, Homo Sapiens
AQAPCPGST

SEQ ID NO: 1401624 - protein, 9 aa, Homo Sapiens
KLEKKQDPK

SEQ ID NO: 1401625 - protein, 9 aa, Homo Sapiens
SFMTHQEAA

SEQ ID NO: 1401626 - protein, 9 aa, Homo Sapiens
DYNMDFLTL

SEQ ID NO: 1401627 - protein, 9 aa, Homo Sapiens
RPRFIRCLM

SEQ ID NO: 1401628 - protein, 9 aa, Homo Sapiens
WPAASVRLD

SEQ ID NO: 1401629 - protein, 9 aa, Homo Sapiens
DPPDLAPNV

SEQ ID NO: 1401630 - protein, 9 aa, Homo Sapiens
ALEELEKMG

SEQ ID NO: 1401631 - protein, 9 aa, Homo Sapiens
TISPFSTVC

SEQ ID NO: 1401632 - protein, 9 aa, Homo Sapiens
DLQRCASLE

SEQ ID NO: 1401633 - protein, 9 aa, Homo Sapiens
QTLEQEKQL

SEQ ID NO: 1401634 - protein, 9 aa, Homo Sapiens
PSAPALRGE

SEQ ID NO: 1401635 - protein, 9 aa, Homo Sapiens
SSGCTYQDV

SEQ ID NO: 1401636 - protein, 9 aa, Homo Sapiens
VKPNMPFIV

SEQ ID NO: 1401637 - protein, 9 aa, Homo Sapiens
LYFGQSQRF

SEQ ID NO: 1401638 - protein, 9 aa, Homo Sapiens
KSSRKDGCY

SEQ ID NO: 1401639 - protein, 9 aa, Homo Sapiens
TPTQIRKRP

SEQ ID NO: 1401640 - protein, 9 aa, Homo Sapiens
DHVRQFLLT

SEQ ID NO: 1401641 - protein, 9 aa, Homo Sapiens
PSTYLLDTE

SEQ ID NO: 1401642 - protein, 9 aa, Homo Sapiens
EENEESDNK

SEQ ID NO: 1401643 - protein, 9 aa, Homo Sapiens
SWATPQRSC

SEQ ID NO: 1401644 - protein, 9 aa, Homo Sapiens
HRRLHALEK

SEQ ID NO: 1401645 - protein, 9 aa, Homo Sapiens
DISFAIHQE

SEQ ID NO: 1401646 - protein, 9 aa, Homo Sapiens
VQAEICSLH

SEQ ID NO: 1401647 - protein, 9 aa, Homo Sapiens
EVILPNPRK

SEQ ID NO: 1401648 - protein, 9 aa, Homo Sapiens
ILVVDWDVY

SEQ ID NO: 1401649 - protein, 9 aa, Homo Sapiens
AKLRWIRII

SEQ ID NO: 1401650 - protein, 9 aa, Homo Sapiens
WDHLSTVYD

SEQ ID NO: 1401651 - protein, 9 aa, Homo Sapiens
TAQNPISQR

SEQ ID NO: 1401652 - protein, 9 aa, Homo Sapiens
TGSGMSTLL

SEQ ID NO: 1401653 - protein, 9 aa, Homo Sapiens
GLTRPESSL

SEQ ID NO: 1401654 - protein, 9 aa, Homo Sapiens
GKVCRRPEN

SEQ ID NO: 1401655 - protein, 9 aa, Homo Sapiens
RITQQKSNT

SEQ ID NO: 1401656 - protein, 9 aa, Homo Sapiens
LLSGSNPPI

SEQ ID NO: 1401657 - protein, 9 aa, Homo Sapiens
HEYPLNLYL

SEQ ID NO: 1401658 - protein, 9 aa, Homo Sapiens
PVGNHEEKI

SEQ ID NO: 1401659 - protein, 9 aa, Homo Sapiens
ANGDYEKAT

SEQ ID NO: 1401660 - protein, 9 aa, Homo Sapiens
VLIEDLELQ

SEQ ID NO: 1401661 - protein, 9 aa, Homo Sapiens
VAGLDREKV

SEQ ID NO: 1401662 - protein, 9 aa, Homo Sapiens
HSTFEDFPQ

SEQ ID NO: 1401663 - protein, 9 aa, Homo Sapiens
DFSKVGPWV

SEQ ID NO: 1401664 - protein, 9 aa, Homo Sapiens
TVEDPFHSW

SEQ ID NO: 1401665 - protein, 9 aa, Homo Sapiens
LDTEQPPHL

SEQ ID NO: 1401666 - protein, 9 aa, Homo Sapiens
EDSLGGSHV

SEQ ID NO: 1401667 - protein, 9 aa, Homo Sapiens
FKCVLCTIS

SEQ ID NO: 1401668 - protein, 9 aa, Homo Sapiens
PVKPNMPFI

SEQ ID NO: 1401669 - protein, 9 aa, Homo Sapiens
ITVYVESIC

SEQ ID NO: 1401670 - protein, 9 aa, Homo Sapiens
VGHGHEAET

SEQ ID NO: 1401671 - protein, 9 aa, Homo Sapiens
WPEEAVGKS

SEQ ID NO: 1401672 - protein, 9 aa, Homo Sapiens
LEKHVERLE

SEQ ID NO: 1401673 - protein, 9 aa, Homo Sapiens
HAGTHQVQN

SEQ ID NO: 1401674 - protein, 9 aa, Homo Sapiens
NPISQRSSL

SEQ ID NO: 1401675 - protein, 9 aa, Homo Sapiens
DLTSLWLPR

SEQ ID NO: 1401676 - protein, 9 aa, Homo Sapiens
RCRIGFSLA

SEQ ID NO: 1401677 - protein, 9 aa, Homo Sapiens
ALQRMTRLH

SEQ ID NO: 1401678 - protein, 9 aa, Homo Sapiens
STLPVGPPA

SEQ ID NO: 1401679 - protein, 9 aa, Homo Sapiens
SLASCASVA

SEQ ID NO: 1401680 - protein, 9 aa, Homo Sapiens
GMLPLEIAL

SEQ ID NO: 1401681 - protein, 9 aa, Homo Sapiens
RPTTEHLYF

SEQ ID NO: 1401682 - protein, 9 aa, Homo Sapiens
FCLRGHPSA

SEQ ID NO: 1401683 - protein, 9 aa, Homo Sapiens
HPQGPCPPP

SEQ ID NO: 1401684 - protein, 9 aa, Homo Sapiens
NFAQVTSTL

SEQ ID NO: 1401685 - protein, 9 aa, Homo Sapiens
ASFETGTKN

SEQ ID NO: 1401686 - protein, 9 aa, Homo Sapiens
LQQTAAKAV

SEQ ID NO: 1401687 - protein, 9 aa, Homo Sapiens
FFFILVPRL

SEQ ID NO: 1401688 - protein, 9 aa, Homo Sapiens
VSLVKVKFE

SEQ ID NO: 1401689 - protein, 9 aa, Homo Sapiens
GHSEDADVI

SEQ ID NO: 1401690 - protein, 9 aa, Homo Sapiens
ENESTHNGN

SEQ ID NO: 1401691 - protein, 9 aa, Homo Sapiens
KVVPSTYLL

SEQ ID NO: 1401692 - protein, 9 aa, Homo Sapiens
KQFLPPKFC

SEQ ID NO: 1401693 - protein, 9 aa, Homo Sapiens
EHPDMKQVY

SEQ ID NO: 1401694 - protein, 9 aa, Homo Sapiens
SHLISKFGD

SEQ ID NO: 1401695 - protein, 9 aa, Homo Sapiens
MAAVPIVIS

SEQ ID NO: 1401696 - protein, 9 aa, Homo Sapiens
FSGWISGSE

SEQ ID NO: 1401697 - protein, 9 aa, Homo Sapiens
YHRFHWVLS

SEQ ID NO: 1401698 - protein, 9 aa, Homo Sapiens
FKVMNELWS

SEQ ID NO: 1401699 - protein, 9 aa, Homo Sapiens
KSHVYFFQA

SEQ ID NO: 1401700 - protein, 9 aa, Homo Sapiens
SGKGRRSSL

SEQ ID NO: 1401701 - protein, 9 aa, Homo Sapiens
GYLTNQLMG

SEQ ID NO: 1401702 - protein, 9 aa, Homo Sapiens
CHQHLCNEH

SEQ ID NO: 1401703 - protein, 9 aa, Homo Sapiens
DCCPSSSKC

SEQ ID NO: 1401704 - protein, 9 aa, Homo Sapiens
VIVGHGHEA

SEQ ID NO: 1401705 - protein, 9 aa, Homo Sapiens
LYFCDDHFQ

SEQ ID NO: 1401706 - protein, 9 aa, Homo Sapiens
FRFQPQVNP

SEQ ID NO: 1401707 - protein, 9 aa, Homo Sapiens
VNHSNDCCP

SEQ ID NO: 1401708 - protein, 9 aa, Homo Sapiens
KINDTEFYW

SEQ ID NO: 1401709 - protein, 9 aa, Homo Sapiens
EAKPHSCPY

SEQ ID NO: 1401710 - protein, 9 aa, Homo Sapiens
GSGMSTLLI

SEQ ID NO: 1401711 - protein, 9 aa, Homo Sapiens
ASHRDVPGS

SEQ ID NO: 1401712 - protein, 9 aa, Homo Sapiens
MSKSSLRVA

SEQ ID NO: 1401713 - protein, 9 aa, Homo Sapiens
PKKTEGVKE

SEQ ID NO: 1401714 - protein, 9 aa, Homo Sapiens
TACSVCPRS

SEQ ID NO: 1401715 - protein, 9 aa, Homo Sapiens
FAVLKQLSP

SEQ ID NO: 1401716 - protein, 9 aa, Homo Sapiens
GSGKGRRSS

SEQ ID NO: 1401717 - protein, 9 aa, Homo Sapiens
IHQEDAKAL

SEQ ID NO: 1401718 - protein, 9 aa, Homo Sapiens
YVGSIDICH

SEQ ID NO: 1401719 - protein, 9 aa, Homo Sapiens
TLQQRHPQG

SEQ ID NO: 1401720 - protein, 9 aa, Homo Sapiens
PPQKFAASR

SEQ ID NO: 1401721 - protein, 9 aa, Homo Sapiens
VACKGKART

SEQ ID NO: 1401722 - protein, 9 aa, Homo Sapiens
NIKSRIAKR

SEQ ID NO: 1401723 - protein, 9 aa, Homo Sapiens
RKRNYVWDD

SEQ ID NO: 1401724 - protein, 9 aa, Homo Sapiens
ETIGVKINE

SEQ ID NO: 1401725 - protein, 9 aa, Homo Sapiens
QAAGAEREH

SEQ ID NO: 1401726 - protein, 9 aa, Homo Sapiens
GGVCHHITG

SEQ ID NO: 1401727 - protein, 9 aa, Homo Sapiens
TLEISNIVF

SEQ ID NO: 1401728 - protein, 9 aa, Homo Sapiens
PSPGRSPQQ

SEQ ID NO: 1401729 - protein, 9 aa, Homo Sapiens
TENSRTQQS

SEQ ID NO: 1401730 - protein, 9 aa, Homo Sapiens
QTAISQHAS

SEQ ID NO: 1401731 - protein, 9 aa, Homo Sapiens
VSSCCRPCC

SEQ ID NO: 1401732 - protein, 9 aa, Homo Sapiens
NNLCNQYEE

SEQ ID NO: 1401733 - protein, 9 aa, Homo Sapiens
PPMCGPDPK

SEQ ID NO: 1401734 - protein, 9 aa, Homo Sapiens
KVQAEICSL

SEQ ID NO: 1401735 - protein, 9 aa, Homo Sapiens
TAVDCLQAF

SEQ ID NO: 1401736 - protein, 9 aa, Homo Sapiens
APEASHDTV

SEQ ID NO: 1401737 - protein, 9 aa, Homo Sapiens
VVMLHINCK

SEQ ID NO: 1401738 - protein, 9 aa, Homo Sapiens
GKFALNAVD

SEQ ID NO: 1401739 - protein, 9 aa, Homo Sapiens
LIGLHGVDG

SEQ ID NO: 1401740 - protein, 9 aa, Homo Sapiens
EDCLCTALS

SEQ ID NO: 1401741 - protein, 9 aa, Homo Sapiens
AEGHKKAFA

SEQ ID NO: 1401742 - protein, 9 aa, Homo Sapiens
ALTKHHWLI

SEQ ID NO: 1401743 - protein, 9 aa, Homo Sapiens
FADNSGMDI

SEQ ID NO: 1401744 - protein, 9 aa, Homo Sapiens
NHYFRNKLI

SEQ ID NO: 1401745 - protein, 9 aa, Homo Sapiens
HSWRKLTIF

SEQ ID NO: 1401746 - protein, 9 aa, Homo Sapiens
QYRALHKYY

SEQ ID NO: 1401747 - protein, 9 aa, Homo Sapiens
AHMFEFFDR

SEQ ID NO: 1401748 - protein, 9 aa, Homo Sapiens
YVCHTELNA

SEQ ID NO: 1401749 - protein, 9 aa, Homo Sapiens
NLCNQYEEK

SEQ ID NO: 1401750 - protein, 9 aa, Homo Sapiens
LRKEKHNAD

SEQ ID NO: 1401751 - protein, 9 aa, Homo Sapiens
LFSTLKPPT

SEQ ID NO: 1401752 - protein, 9 aa, Homo Sapiens
RARQSCCLP

SEQ ID NO: 1401753 - protein, 9 aa, Homo Sapiens
YLKAKRYVG

SEQ ID NO: 1401754 - protein, 9 aa, Homo Sapiens
SWPEEAVGK

SEQ ID NO: 1401755 - protein, 9 aa, Homo Sapiens
HDNDSRLAD

SEQ ID NO: 1401756 - protein, 9 aa, Homo Sapiens
LTLTEHKVM

SEQ ID NO: 1401757 - protein, 9 aa, Homo Sapiens
RVNVHSPHL

SEQ ID NO: 1401758 - protein, 9 aa, Homo Sapiens
SGMDIILGV

SEQ ID NO: 1401759 - protein, 9 aa, Homo Sapiens
ELALQGQTG

SEQ ID NO: 1401760 - protein, 9 aa, Homo Sapiens
MEAEQEMVC

SEQ ID NO: 1401761 - protein, 9 aa, Homo Sapiens
ARLCQSLGN

SEQ ID NO: 1401762 - protein, 9 aa, Homo Sapiens
LLVFSFFFC

SEQ ID NO: 1401763 - protein, 9 aa, Homo Sapiens
SGSTETTTL

SEQ ID NO: 1401764 - protein, 9 aa, Homo Sapiens
RLHLAKHEA

SEQ ID NO: 1401765 - protein, 9 aa, Homo Sapiens
NYLPCPIHQ

SEQ ID NO: 1401766 - protein, 9 aa, Homo Sapiens
MLPTLSTLQ

SEQ ID NO: 1401767 - protein, 9 aa, Homo Sapiens
TFMGQLLEF

SEQ ID NO: 1401768 - protein, 9 aa, Homo Sapiens
PRVAHACAT

SEQ ID NO: 1401769 - protein, 9 aa, Homo Sapiens
AALLLRSSM

SEQ ID NO: 1401770 - protein, 9 aa, Homo Sapiens
KAELHILDV

SEQ ID NO: 1401771 - protein, 9 aa, Homo Sapiens
FYCGMAAVP

SEQ ID NO: 1401772 - protein, 9 aa, Homo Sapiens
LWMKIYFQS

SEQ ID NO: 1401773 - protein, 9 aa, Homo Sapiens
FVITLISVS

SEQ ID NO: 1401774 - protein, 9 aa, Homo Sapiens
LWDLASVTL

SEQ ID NO: 1401775 - protein, 9 aa, Homo Sapiens
EEGSTIEAS

SEQ ID NO: 1401776 - protein, 9 aa, Homo Sapiens
GHPSAFNNL

SEQ ID NO: 1401777 - protein, 9 aa, Homo Sapiens
ACFAQAHFD

SEQ ID NO: 1401778 - protein, 9 aa, Homo Sapiens
AGFQWGESP

SEQ ID NO: 1401779 - protein, 9 aa, Homo Sapiens
PCRLNKLPN

SEQ ID NO: 1401780 - protein, 9 aa, Homo Sapiens
PCPIHQVRH

SEQ ID NO: 1401781 - protein, 9 aa, Homo Sapiens
CWDSPDGMP

SEQ ID NO: 1401782 - protein, 9 aa, Homo Sapiens
LWPAASVRL

SEQ ID NO: 1401783 - protein, 9 aa, Homo Sapiens
RLIIFKGAR

SEQ ID NO: 1401784 - protein, 9 aa, Homo Sapiens
RRKKKVRSL

SEQ ID NO: 1401785 - protein, 9 aa, Homo Sapiens
QCTPQPCPP

SEQ ID NO: 1401786 - protein, 9 aa, Homo Sapiens
SYLEMTVSG

SEQ ID NO: 1401787 - protein, 9 aa, Homo Sapiens
AALWPLGGP

SEQ ID NO: 1401788 - protein, 9 aa, Homo Sapiens
IHVAIVCTG

SEQ ID NO: 1401789 - protein, 9 aa, Homo Sapiens
LEEEEEEQK

SEQ ID NO: 1401790 - protein, 9 aa, Homo Sapiens
CRDNRERDQ

SEQ ID NO: 1401791 - protein, 9 aa, Homo Sapiens
QSPSHEAIH

SEQ ID NO: 1401792 - protein, 9 aa, Homo Sapiens
SFSGHPTMW

SEQ ID NO: 1401793 - protein, 9 aa, Homo Sapiens
GEKIFYLIH

SEQ ID NO: 1401794 - protein, 9 aa, Homo Sapiens
FPFFFILVP

SEQ ID NO: 1401795 - protein, 9 aa, Homo Sapiens
AGHGASLQV

SEQ ID NO: 1401796 - protein, 9 aa, Homo Sapiens
CTGYNASRD

SEQ ID NO: 1401797 - protein, 9 aa, Homo Sapiens
SWKLLNYQM

SEQ ID NO: 1401798 - protein, 9 aa, Homo Sapiens
EKRSKALKS

SEQ ID NO: 1401799 - protein, 9 aa, Homo Sapiens
KHPSVEEIK

SEQ ID NO: 1401800 - protein, 9 aa, Homo Sapiens
CTPVPVACP

SEQ ID NO: 1401801 - protein, 9 aa, Homo Sapiens
VPRLECSGT

SEQ ID NO: 1401802 - protein, 9 aa, Homo Sapiens
GQQEEELTA

SEQ ID NO: 1401803 - protein, 9 aa, Homo Sapiens
IVHVSFILV

SEQ ID NO: 1401804 - protein, 9 aa, Homo Sapiens
VLGTAQWAI

SEQ ID NO: 1401805 - protein, 9 aa, Homo Sapiens
ETGDIVTVV

SEQ ID NO: 1401806 - protein, 9 aa, Homo Sapiens
LSIFMGLSS

SEQ ID NO: 1401807 - protein, 9 aa, Homo Sapiens
ELISALRRS

SEQ ID NO: 1401808 - protein, 9 aa, Homo Sapiens
EDFPQSLLQ

SEQ ID NO: 1401809 - protein, 9 aa, Homo Sapiens
ITGECSCPS

SEQ ID NO: 1401810 - protein, 9 aa, Homo Sapiens
NPPVWYSWR

SEQ ID NO: 1401811 - protein, 9 aa, Homo Sapiens
KRNYVWDDA

SEQ ID NO: 1401812 - protein, 9 aa, Homo Sapiens
KPVCSVPVC

SEQ ID NO: 1401813 - protein, 9 aa, Homo Sapiens
LFLSNCHNS

SEQ ID NO: 1401814 - protein, 9 aa, Homo Sapiens
FPVLFLDLM

SEQ ID NO: 1401815 - protein, 9 aa, Homo Sapiens
DNSGMDIIL

SEQ ID NO: 1401816 - protein, 9 aa, Homo Sapiens
NTYIHYELD

SEQ ID NO: 1401817 - protein, 9 aa, Homo Sapiens
VAFFFSGWI

SEQ ID NO: 1401818 - protein, 9 aa, Homo Sapiens
APQIDKEAT

SEQ ID NO: 1401819 - protein, 9 aa, Homo Sapiens
AELHILDVK

SEQ ID NO: 1401820 - protein, 9 aa, Homo Sapiens
CFNSQSQAE

SEQ ID NO: 1401821 - protein, 9 aa, Homo Sapiens
LAPINAFIW

SEQ ID NO: 1401822 - protein, 9 aa, Homo Sapiens
IIEDSLWTE

SEQ ID NO: 1401823 - protein, 9 aa, Homo Sapiens
NHGEVQCTP

SEQ ID NO: 1401824 - protein, 9 aa, Homo Sapiens
QEADAHHDH

SEQ ID NO: 1401825 - protein, 9 aa, Homo Sapiens
PDPKYPQDN

SEQ ID NO: 1401826 - protein, 9 aa, Homo Sapiens
ECSGTILAY

SEQ ID NO: 1401827 - protein, 9 aa, Homo Sapiens
PLALSGLPG

SEQ ID NO: 1401828 - protein, 9 aa, Homo Sapiens
EKLAVLKDW

SEQ ID NO: 1401829 - protein, 9 aa, Homo Sapiens
LVKVKFEDI

SEQ ID NO: 1401830 - protein, 9 aa, Homo Sapiens
GTTSDILTL

SEQ ID NO: 1401831 - protein, 9 aa, Homo Sapiens
RSRTASASR

SEQ ID NO: 1401832 - protein, 9 aa, Homo Sapiens
GPLLHLVAE

SEQ ID NO: 1401833 - protein, 9 aa, Homo Sapiens
DAHHDHNCR

SEQ ID NO: 1401834 - protein, 9 aa, Homo Sapiens
LISALRRSW

SEQ ID NO: 1401835 - protein, 9 aa, Homo Sapiens
DQDRKSEEC

SEQ ID NO: 1401836 - protein, 9 aa, Homo Sapiens
AQVAEDRPG

SEQ ID NO: 1401837 - protein, 9 aa, Homo Sapiens
QPGEKKSQA

SEQ ID NO: 1401838 - protein, 9 aa, Homo Sapiens
ALTSLPGPN

SEQ ID NO: 1401839 - protein, 9 aa, Homo Sapiens
FILLHPAGV

SEQ ID NO: 1401840 - protein, 9 aa, Homo Sapiens
SPGRSPQQL

SEQ ID NO: 1401841 - protein, 9 aa, Homo Sapiens
SSFNICGSL

SEQ ID NO: 1401842 - protein, 9 aa, Homo Sapiens
GDIIRFAPQ

SEQ ID NO: 1401843 - protein, 9 aa, Homo Sapiens
QLDTEQPPH

SEQ ID NO: 1401844 - protein, 9 aa, Homo Sapiens
ITHLDRLVA

SEQ ID NO: 1401845 - protein, 9 aa, Homo Sapiens
IYSIPPAFR

SEQ ID NO: 1401846 - protein, 9 aa, Homo Sapiens
MKDGKWEQK

SEQ ID NO: 1401847 - protein, 9 aa, Homo Sapiens
MLDEHLEID

SEQ ID NO: 1401848 - protein, 9 aa, Homo Sapiens
SPQQLKETR

SEQ ID NO: 1401849 - protein, 9 aa, Homo Sapiens
QAHFDFSAQ

SEQ ID NO: 1401850 - protein, 9 aa, Homo Sapiens
SSPLPRSFG

SEQ ID NO: 1401851 - protein, 9 aa, Homo Sapiens
SFSLPINPS

SEQ ID NO: 1401852 - protein, 9 aa, Homo Sapiens
GPAVSHRGC

SEQ ID NO: 1401853 - protein, 9 aa, Homo Sapiens
RATWSKDGA

SEQ ID NO: 1401854 - protein, 9 aa, Homo Sapiens
QSRLVCGRH

SEQ ID NO: 1401855 - protein, 9 aa, Homo Sapiens
PSSVHLYFC

SEQ ID NO: 1401856 - protein, 9 aa, Homo Sapiens
IQSHKLLNR

SEQ ID NO: 1401857 - protein, 9 aa, Homo Sapiens
PTKNTREGG

SEQ ID NO: 1401858 - protein, 9 aa, Homo Sapiens
ARWVVFCQL

SEQ ID NO: 1401859 - protein, 9 aa, Homo Sapiens
GSCGDRSGF

SEQ ID NO: 1401860 - protein, 9 aa, Homo Sapiens
EPVGNHEEK

SEQ ID NO: 1401861 - protein, 9 aa, Homo Sapiens
GCTYQDVGV

SEQ ID NO: 1401862 - protein, 9 aa, Homo Sapiens
QIHLHLTPT

SEQ ID NO: 1401863 - protein, 9 aa, Homo Sapiens
SGWISGSEA

SEQ ID NO: 1401864 - protein, 9 aa, Homo Sapiens
PINPSYLEM

SEQ ID NO: 1401865 - protein, 9 aa, Homo Sapiens
CEQNLRPNI

SEQ ID NO: 1401866 - protein, 9 aa, Homo Sapiens
MYPKVIERR

SEQ ID NO: 1401867 - protein, 9 aa, Homo Sapiens
TDTSKHIKE

SEQ ID NO: 1401868 - protein, 9 aa, Homo Sapiens
IVHKYMQKE

SEQ ID NO: 1401869 - protein, 9 aa, Homo Sapiens
GLLPLCCPD

SEQ ID NO: 1401870 - protein, 9 aa, Homo Sapiens
LKIASAEGH

SEQ ID NO: 1401871 - protein, 9 aa, Homo Sapiens
HQGFGLTAT

SEQ ID NO: 1401872 - protein, 9 aa, Homo Sapiens
IPPQGLKMS

SEQ ID NO: 1401873 - protein, 9 aa, Homo Sapiens
SKINDTEFY

SEQ ID NO: 1401874 - protein, 9 aa, Homo Sapiens
WGLSPRKLL

SEQ ID NO: 1401875 - protein, 9 aa, Homo Sapiens
SLGGSHVVV

SEQ ID NO: 1401876 - protein, 9 aa, Homo Sapiens
QHALAQAIA

SEQ ID NO: 1401877 - protein, 9 aa, Homo Sapiens
MFRQFHADF

SEQ ID NO: 1401878 - protein, 9 aa, Homo Sapiens
PAPLLAVSA

SEQ ID NO: 1401879 - protein, 9 aa, Homo Sapiens
EELISALRR

SEQ ID NO: 1401880 - protein, 9 aa, Homo Sapiens
YWVLRPTTE

SEQ ID NO: 1401881 - protein, 9 aa, Homo Sapiens
QLKLLHERL

SEQ ID NO: 1401882 - protein, 9 aa, Homo Sapiens
RRLIIFKGA

SEQ ID NO: 1401883 - protein, 9 aa, Homo Sapiens
HHQGFGLTA

SEQ ID NO: 1401884 - protein, 9 aa, Homo Sapiens
QVLLDNVLS

SEQ ID NO: 1401885 - protein, 9 aa, Homo Sapiens
TPSSTHAPA

SEQ ID NO: 1401886 - protein, 9 aa, Homo Sapiens
HWRIGGGTP

SEQ ID NO: 1401887 - protein, 9 aa, Homo Sapiens
EYGIGLSAE

SEQ ID NO: 1401888 - protein, 9 aa, Homo Sapiens
AWVENALNN

SEQ ID NO: 1401889 - protein, 9 aa, Homo Sapiens
HVRQFLLTF

SEQ ID NO: 1401890 - protein, 9 aa, Homo Sapiens
ADNSGMDII

SEQ ID NO: 1401891 - protein, 9 aa, Homo Sapiens
VVPAALLLR

SEQ ID NO: 1401892 - protein, 9 aa, Homo Sapiens
SRWCSGWAT

SEQ ID NO: 1401893 - protein, 9 aa, Homo Sapiens
RLCANLMQL

SEQ ID NO: 1401894 - protein, 9 aa, Homo Sapiens
SCGDRSGFG

SEQ ID NO: 1401895 - protein, 9 aa, Homo Sapiens
RSTEGLARL

SEQ ID NO: 1401896 - protein, 9 aa, Homo Sapiens
ELEKMGNFL

SEQ ID NO: 1401897 - protein, 9 aa, Homo Sapiens
ASASRHAGK

SEQ ID NO: 1401898 - protein, 9 aa, Homo Sapiens
QFLVASLHT

SEQ ID NO: 1401899 - protein, 9 aa, Homo Sapiens
PRRRSTEGL

SEQ ID NO: 1401900 - protein, 9 aa, Homo Sapiens
CSLSFPGSS

SEQ ID NO: 1401901 - protein, 9 aa, Homo Sapiens
ISILNEHVE

SEQ ID NO: 1401902 - protein, 9 aa, Homo Sapiens
QAPQVAMLP

SEQ ID NO: 1401903 - protein, 9 aa, Homo Sapiens
QDGKITWQE

SEQ ID NO: 1401904 - protein, 9 aa, Homo Sapiens
AEYEDGSSI

SEQ ID NO: 1401905 - protein, 9 aa, Homo Sapiens
LGASAPCGA

SEQ ID NO: 1401906 - protein, 9 aa, Homo Sapiens
DFIQPNSRE

SEQ ID NO: 1401907 - protein, 9 aa, Homo Sapiens
HSCPYMAFV

SEQ ID NO: 1401908 - protein, 9 aa, Homo Sapiens
AEDRPGAFI

SEQ ID NO: 1401909 - protein, 9 aa, Homo Sapiens
ILQFNLLGC

SEQ ID NO: 1401910 - protein, 9 aa, Homo Sapiens
RAAARWSAR

SEQ ID NO: 1401911 - protein, 9 aa, Homo Sapiens
EATSQYYFR

SEQ ID NO: 1401912 - protein, 9 aa, Homo Sapiens
LLDQFSAFP

SEQ ID NO: 1401913 - protein, 9 aa, Homo Sapiens
FLDLMTICG

SEQ ID NO: 1401914 - protein, 9 aa, Homo Sapiens
SWFPENGLP

SEQ ID NO: 1401915 - protein, 9 aa, Homo Sapiens
CVQELGLSA

SEQ ID NO: 1401916 - protein, 9 aa, Homo Sapiens
PHLAMAALG

SEQ ID NO: 1401917 - protein, 9 aa, Homo Sapiens
APRCPRSAV

SEQ ID NO: 1401918 - protein, 9 aa, Homo Sapiens
PVGRQNHKV

SEQ ID NO: 1401919 - protein, 9 aa, Homo Sapiens
QFHADFTSL

SEQ ID NO: 1401920 - protein, 9 aa, Homo Sapiens
ARSRARTRW

SEQ ID NO: 1401921 - protein, 9 aa, Homo Sapiens
VWSFMTHQE

SEQ ID NO: 1401922 - protein, 9 aa, Homo Sapiens
DMHMQISNA

SEQ ID NO: 1401923 - protein, 9 aa, Homo Sapiens
TSPVKGLWV

SEQ ID NO: 1401924 - protein, 9 aa, Homo Sapiens
VAEDRPGAF

SEQ ID NO: 1401925 - protein, 9 aa, Homo Sapiens
DIHLLYTES

SEQ ID NO: 1401926 - protein, 9 aa, Homo Sapiens
FDGGIVMGS

SEQ ID NO: 1401927 - protein, 9 aa, Homo Sapiens
PFFLLFTWQ

SEQ ID NO: 1401928 - protein, 9 aa, Homo Sapiens
SKCHNKQVE

SEQ ID NO: 1401929 - protein, 9 aa, Homo Sapiens
VIWDHLSTV

SEQ ID NO: 1401930 - protein, 9 aa, Homo Sapiens
ESDNKKETE

SEQ ID NO: 1401931 - protein, 9 aa, Homo Sapiens
GTQTEKEDN

SEQ ID NO: 1401932 - protein, 9 aa, Homo Sapiens
GIATNVHPG

SEQ ID NO: 1401933 - protein, 9 aa, Homo Sapiens
HKVMHSKSL

SEQ ID NO: 1401934 - protein, 9 aa, Homo Sapiens
SPDFHERLK

SEQ ID NO: 1401935 - protein, 9 aa, Homo Sapiens
YEKATEFYK

SEQ ID NO: 1401936 - protein, 9 aa, Homo Sapiens
KQQEERLQQ

SEQ ID NO: 1401937 - protein, 9 aa, Homo Sapiens
RYVYHGSQW

SEQ ID NO: 1401938 - protein, 9 aa, Homo Sapiens
ELDALLCHA

SEQ ID NO: 1401939 - protein, 9 aa, Homo Sapiens
PSDAQQAMA

SEQ ID NO: 1401940 - protein, 9 aa, Homo Sapiens
DSLTYNIAN

SEQ ID NO: 1401941 - protein, 9 aa, Homo Sapiens
FQRNHYFRN

SEQ ID NO: 1401942 - protein, 9 aa, Homo Sapiens
MSELKMVTS

SEQ ID NO: 1401943 - protein, 9 aa, Homo Sapiens
QPPKALVKV

SEQ ID NO: 1401944 - protein, 9 aa, Homo Sapiens
LSCASSGAS

SEQ ID NO: 1401945 - protein, 9 aa, Homo Sapiens
VLAQEGRFG

SEQ ID NO: 1401946 - protein, 9 aa, Homo Sapiens
PEQLPQHAL

SEQ ID NO: 1401947 - protein, 9 aa, Homo Sapiens
PRCPRSAVD

SEQ ID NO: 1401948 - protein, 9 aa, Homo Sapiens
TLPGSTTTA

SEQ ID NO: 1401949 - protein, 9 aa, Homo Sapiens
CTYQDVGVT

SEQ ID NO: 1401950 - protein, 9 aa, Homo Sapiens
DADVICSGP

SEQ ID NO: 1401951 - protein, 9 aa, Homo Sapiens
MVTSTGLFQ

SEQ ID NO: 1401952 - protein, 9 aa, Homo Sapiens
CQLWMKIYF

SEQ ID NO: 1401953 - protein, 9 aa, Homo Sapiens
GTAGARHHT

SEQ ID NO: 1401954 - protein, 9 aa, Homo Sapiens
VENEHVNRL

SEQ ID NO: 1401955 - protein, 9 aa, Homo Sapiens
HLDRLVAFP

SEQ ID NO: 1401956 - protein, 9 aa, Homo Sapiens
LKSGDAAAA

SEQ ID NO: 1401957 - protein, 9 aa, Homo Sapiens
LGVFYNEIL

SEQ ID NO: 1401958 - protein, 9 aa, Homo Sapiens
FPNIKSRIA

SEQ ID NO: 1401959 - protein, 9 aa, Homo Sapiens
SAGPLLHLV

SEQ ID NO: 1401960 - protein, 9 aa, Homo Sapiens
PAGVFHIGP

SEQ ID NO: 1401961 - protein, 9 aa, Homo Sapiens
GSQWMVAGN

SEQ ID NO: 1401962 - protein, 9 aa, Homo Sapiens
SGGAGHSHH

SEQ ID NO: 1401963 - protein, 9 aa, Homo Sapiens
VYFFHFLGS

SEQ ID NO: 1401964 - protein, 9 aa, Homo Sapiens
NYVWDDAVF

SEQ ID NO: 1401965 - protein, 9 aa, Homo Sapiens
EQAMTAIQS

SEQ ID NO: 1401966 - protein, 9 aa, Homo Sapiens
EKKQDPKGK

SEQ ID NO: 1401967 - protein, 9 aa, Homo Sapiens
NCGHSEDAD

SEQ ID NO: 1401968 - protein, 9 aa, Homo Sapiens
KPCRRKKKV

SEQ ID NO: 1401969 - protein, 9 aa, Homo Sapiens
VVPVLVSSQ

SEQ ID NO: 1401970 - protein, 9 aa, Homo Sapiens
GTTTACSVC

SEQ ID NO: 1401971 - protein, 9 aa, Homo Sapiens
NCIYPLSMC

SEQ ID NO: 1401972 - protein, 9 aa, Homo Sapiens
PGMAQRPDG

SEQ ID NO: 1401973 - protein, 9 aa, Homo Sapiens
KEVKGPGRN

SEQ ID NO: 1401974 - protein, 9 aa, Homo Sapiens
PAALPKKKK

SEQ ID NO: 1401975 - protein, 9 aa, Homo Sapiens
SHRDQSETQ

SEQ ID NO: 1401976 - protein, 9 aa, Homo Sapiens
ASHMMTFFI

SEQ ID NO: 1401977 - protein, 9 aa, Homo Sapiens
KVGPWVRFP

SEQ ID NO: 1401978 - protein, 9 aa, Homo Sapiens
HSSGLLSGQ

SEQ ID NO: 1401979 - protein, 9 aa, Homo Sapiens
ISEGLVMYP

SEQ ID NO: 1401980 - protein, 9 aa, Homo Sapiens
SGRLAWVEN

SEQ ID NO: 1401981 - protein, 9 aa, Homo Sapiens
KLALLGASA

SEQ ID NO: 1401982 - protein, 9 aa, Homo Sapiens
YCGMAAVPI

SEQ ID NO: 1401983 - protein, 9 aa, Homo Sapiens
WSKQLLCDV

SEQ ID NO: 1401984 - protein, 9 aa, Homo Sapiens
TRREDKVHV

SEQ ID NO: 1401985 - protein, 9 aa, Homo Sapiens
VLHNIVSIF

SEQ ID NO: 1401986 - protein, 9 aa, Homo Sapiens
DKLKGVSLV

SEQ ID NO: 1401987 - protein, 9 aa, Homo Sapiens
KVITVYVES

SEQ ID NO: 1401988 - protein, 9 aa, Homo Sapiens
KDWAEVYVV

SEQ ID NO: 1401989 - protein, 9 aa, Homo Sapiens
AAAPTPTGR

SEQ ID NO: 1401990 - protein, 9 aa, Homo Sapiens
EYELEKHVE

SEQ ID NO: 1401991 - protein, 9 aa, Homo Sapiens
VCQVTAIGA

SEQ ID NO: 1401992 - protein, 9 aa, Homo Sapiens
AIKKTWTSA

SEQ ID NO: 1401993 - protein, 9 aa, Homo Sapiens
DSRDGWGGL

SEQ ID NO: 1401994 - protein, 9 aa, Homo Sapiens
AALSTPSSS

SEQ ID NO: 1401995 - protein, 9 aa, Homo Sapiens
NSVGPSCLK

SEQ ID NO: 1401996 - protein, 9 aa, Homo Sapiens
MVFMTSSPS

SEQ ID NO: 1401997 - protein, 9 aa, Homo Sapiens
GVSGSSTGP

SEQ ID NO: 1401998 - protein, 9 aa, Homo Sapiens
LSFSLPINP

SEQ ID NO: 1401999 - protein, 9 aa, Homo Sapiens
ASVTLYKEL

SEQ ID NO: 1402000 - protein, 9 aa, Homo Sapiens
HEIQEKLCL

SEQ ID NO: 1402001 - protein, 9 aa, Homo Sapiens
HGRLVIVGH

SEQ ID NO: 1402002 - protein, 9 aa, Homo Sapiens
PSGSFLSSW

SEQ ID NO: 1402003 - protein, 9 aa, Homo Sapiens
GWISGSEAT

SEQ ID NO: 1402004 - protein, 9 aa, Homo Sapiens
AGASASRHA

SEQ ID NO: 1402005 - protein, 9 aa, Homo Sapiens
DFLTLRHLM

SEQ ID NO: 1402006 - protein, 9 aa, Homo Sapiens
GKQKREDEA

SEQ ID NO: 1402007 - protein, 9 aa, Homo Sapiens
ALSCASSGA

SEQ ID NO: 1402008 - protein, 9 aa, Homo Sapiens
SPSLASCAS

SEQ ID NO: 1402009 - protein, 9 aa, Homo Sapiens
VTVVAGLDR

SEQ ID NO: 1402010 - protein, 9 aa, Homo Sapiens
TCTARFIVV

SEQ ID NO: 1402011 - protein, 9 aa, Homo Sapiens
PHVTLAPLP

SEQ ID NO: 1402012 - protein, 9 aa, Homo Sapiens
TECSLAIEI

SEQ ID NO: 1402013 - protein, 9 aa, Homo Sapiens
LMGGMSRTP

SEQ ID NO: 1402014 - protein, 9 aa, Homo Sapiens
NIVSIFTFM

SEQ ID NO: 1402015 - protein, 9 aa, Homo Sapiens
HPTNANLTL

SEQ ID NO: 1402016 - protein, 9 aa, Homo Sapiens
DGVGKSALT

SEQ ID NO: 1402017 - protein, 9 aa, Homo Sapiens
VRADGERQN

SEQ ID NO: 1402018 - protein, 9 aa, Homo Sapiens
KSKSCLRAL

SEQ ID NO: 1402019 - protein, 9 aa, Homo Sapiens
SWCPPGTTA

SEQ ID NO: 1402020 - protein, 9 aa, Homo Sapiens
LKLLHERLS

SEQ ID NO: 1402021 - protein, 9 aa, Homo Sapiens
PPPQNGQNP

SEQ ID NO: 1402022 - protein, 9 aa, Homo Sapiens
LATVQPQSP

SEQ ID NO: 1402023 - protein, 9 aa, Homo Sapiens
TSILQDGIT

SEQ ID NO: 1402024 - protein, 9 aa, Homo Sapiens
RPHISSKVR

SEQ ID NO: 1402025 - protein, 9 aa, Homo Sapiens
GTPLSISRP

SEQ ID NO: 1402026 - protein, 9 aa, Homo Sapiens
GVINMGNSL

SEQ ID NO: 1402027 - protein, 9 aa, Homo Sapiens
FSGHPTMWL

SEQ ID NO: 1402028 - protein, 9 aa, Homo Sapiens
ALSTCTARF

SEQ ID NO: 1402029 - protein, 9 aa, Homo Sapiens
IGKNSPKKL

SEQ ID NO: 1402030 - protein, 9 aa, Homo Sapiens
KKAHPLRLQ

SEQ ID NO: 1402031 - protein, 9 aa, Homo Sapiens
YHALPFFLL

SEQ ID NO: 1402032 - protein, 9 aa, Homo Sapiens
VQAGDGHGR

SEQ ID NO: 1402033 - protein, 9 aa, Homo Sapiens
EKKQTEGGR

SEQ ID NO: 1402034 - protein, 9 aa, Homo Sapiens
PPKFCRTTE

SEQ ID NO: 1402035 - protein, 9 aa, Homo Sapiens
GDYEKATEF

SEQ ID NO: 1402036 - protein, 9 aa, Homo Sapiens
SFSPNFAQV

SEQ ID NO: 1402037 - protein, 9 aa, Homo Sapiens
DLASVTLYK

SEQ ID NO: 1402038 - protein, 9 aa, Homo Sapiens
KKKKVWSFM

SEQ ID NO: 1402039 - protein, 9 aa, Homo Sapiens
HNFNEFLFH

SEQ ID NO: 1402040 - protein, 9 aa, Homo Sapiens
RYVGSIDIC

SEQ ID NO: 1402041 - protein, 9 aa, Homo Sapiens
LFRVVTLEN

SEQ ID NO: 1402042 - protein, 9 aa, Homo Sapiens
KAWRASHMM

SEQ ID NO: 1402043 - protein, 9 aa, Homo Sapiens
LYHRFHWVL

SEQ ID NO: 1402044 - protein, 9 aa, Homo Sapiens
SPVDLPTEC

SEQ ID NO: 1402045 - protein, 9 aa, Homo Sapiens
GSSSKIRTR

SEQ ID NO: 1402046 - protein, 9 aa, Homo Sapiens
GIVKNLFKW

SEQ ID NO: 1402047 - protein, 9 aa, Homo Sapiens
KLTKVQAEI

SEQ ID NO: 1402048 - protein, 9 aa, Homo Sapiens
RGVHAAPSA

SEQ ID NO: 1402049 - protein, 9 aa, Homo Sapiens
FGQGVHHVA

SEQ ID NO: 1402050 - protein, 9 aa, Homo Sapiens
SKSSGCTYQ

SEQ ID NO: 1402051 - protein, 9 aa, Homo Sapiens
FVLVNLEVT

SEQ ID NO: 1402052 - protein, 9 aa, Homo Sapiens
KEEPVSSWP

SEQ ID NO: 1402053 - protein, 9 aa, Homo Sapiens
LPIQFKQLA

SEQ ID NO: 1402054 - protein, 9 aa, Homo Sapiens
YEEEINKHT

SEQ ID NO: 1402055 - protein, 9 aa, Homo Sapiens
WWHLCVQEL

SEQ ID NO: 1402056 - protein, 9 aa, Homo Sapiens
GRDTGPGKQ

SEQ ID NO: 1402057 - protein, 9 aa, Homo Sapiens
KGNLERLHL

SEQ ID NO: 1402058 - protein, 9 aa, Homo Sapiens
QLRKDHVRQ

SEQ ID NO: 1402059 - protein, 9 aa, Homo Sapiens
ELWSKQLLC

SEQ ID NO: 1402060 - protein, 9 aa, Homo Sapiens
TSEDAVGEP

SEQ ID NO: 1402061 - protein, 9 aa, Homo Sapiens
GTGSGMSTL

SEQ ID NO: 1402062 - protein, 9 aa, Homo Sapiens
ITNEPTTGM

SEQ ID NO: 1402063 - protein, 9 aa, Homo Sapiens
WIRIIPDVA

SEQ ID NO: 1402064 - protein, 9 aa, Homo Sapiens
RNHYFRNKL

SEQ ID NO: 1402065 - protein, 9 aa, Homo Sapiens
DPPPQNGQN

SEQ ID NO: 1402066 - protein, 9 aa, Homo Sapiens
HNGNNAVSE

SEQ ID NO: 1402067 - protein, 9 aa, Homo Sapiens
HSQSAEAGR

SEQ ID NO: 1402068 - protein, 9 aa, Homo Sapiens
EPLCPLKHH

SEQ ID NO: 1402069 - protein, 9 aa, Homo Sapiens
AELRNFHRD

SEQ ID NO: 1402070 - protein, 9 aa, Homo Sapiens
AFESHHQGF

SEQ ID NO: 1402071 - protein, 9 aa, Homo Sapiens
DMFRQFHAD

SEQ ID NO: 1402072 - protein, 9 aa, Homo Sapiens
VHETCAQTL

SEQ ID NO: 1402073 - protein, 9 aa, Homo Sapiens
SKSCLRALF

SEQ ID NO: 1402074 - protein, 9 aa, Homo Sapiens
TTACSVCPR

SEQ ID NO: 1402075 - protein, 9 aa, Homo Sapiens
EEDFIQPNS

SEQ ID NO: 1402076 - protein, 9 aa, Homo Sapiens
NPVLEMMPA

SEQ ID NO: 1402077 - protein, 9 aa, Homo Sapiens
SGPTSAASW

SEQ ID NO: 1402078 - protein, 9 aa, Homo Sapiens
GSLEELSRE

SEQ ID NO: 1402079 - protein, 9 aa, Homo Sapiens
GEPSGSSSK

SEQ ID NO: 1402080 - protein, 9 aa, Homo Sapiens
AENNLCNQY

SEQ ID NO: 1402081 - protein, 9 aa, Homo Sapiens
HQAPQVAML

SEQ ID NO: 1402082 - protein, 9 aa, Homo Sapiens
YLSIFMGLS

SEQ ID NO: 1402083 - protein, 9 aa, Homo Sapiens
QECDKVFER

SEQ ID NO: 1402084 - protein, 9 aa, Homo Sapiens
QQVLLDNVL

SEQ ID NO: 1402085 - protein, 9 aa, Homo Sapiens
CGTTTACSV

SEQ ID NO: 1402086 - protein, 9 aa, Homo Sapiens
RFQPQVNPV

SEQ ID NO: 1402087 - protein, 9 aa, Homo Sapiens
IAIEHVQSL

SEQ ID NO: 1402088 - protein, 9 aa, Homo Sapiens
SRARQSCCL

SEQ ID NO: 1402089 - protein, 9 aa, Homo Sapiens
VLVLIGLHG

SEQ ID NO: 1402090 - protein, 9 aa, Homo Sapiens
SMRYFLVKR

SEQ ID NO: 1402091 - protein, 9 aa, Homo Sapiens
AASSHRLRV

SEQ ID NO: 1402092 - protein, 9 aa, Homo Sapiens
NPELDALLC

SEQ ID NO: 1402093 - protein, 9 aa, Homo Sapiens
SILNEHVEL

SEQ ID NO: 1402094 - protein, 9 aa, Homo Sapiens
LVLRDVAAE

SEQ ID NO: 1402095 - protein, 9 aa, Homo Sapiens
FLEHEGNFG

SEQ ID NO: 1402096 - protein, 9 aa, Homo Sapiens
NGNNAVSEN

SEQ ID NO: 1402097 - protein, 9 aa, Homo Sapiens
GTTEPFMTH

SEQ ID NO: 1402098 - protein, 9 aa, Homo Sapiens
TREIFVLFL

SEQ ID NO: 1402099 - protein, 9 aa, Homo Sapiens
THNGNNAVS

SEQ ID NO: 1402100 - protein, 9 aa, Homo Sapiens
SSLRVATEL

SEQ ID NO: 1402101 - protein, 9 aa, Homo Sapiens
WRKVQSLGV

SEQ ID NO: 1402102 - protein, 9 aa, Homo Sapiens
RLVIVGHGH

SEQ ID NO: 1402103 - protein, 9 aa, Homo Sapiens
GAAGAREAG

SEQ ID NO: 1402104 - protein, 9 aa, Homo Sapiens
LRPLGGPSL

SEQ ID NO: 1402105 - protein, 9 aa, Homo Sapiens
QKPKNKENI

SEQ ID NO: 1402106 - protein, 9 aa, Homo Sapiens
NEHVNRLQS

SEQ ID NO: 1402107 - protein, 9 aa, Homo Sapiens
GPIIFSLRN

SEQ ID NO: 1402108 - protein, 9 aa, Homo Sapiens
WAAAPTPTG

SEQ ID NO: 1402109 - protein, 9 aa, Homo Sapiens
GRRSSLLWP

SEQ ID NO: 1402110 - protein, 9 aa, Homo Sapiens
METVNLLSS

SEQ ID NO: 1402111 - protein, 9 aa, Homo Sapiens
NNYLPCPIH

SEQ ID NO: 1402112 - protein, 9 aa, Homo Sapiens
LRMDGNYNL

SEQ ID NO: 1402113 - protein, 9 aa, Homo Sapiens
GGRWKEKSK

SEQ ID NO: 1402114 - protein, 9 aa, Homo Sapiens
QILPAALPK

SEQ ID NO: 1402115 - protein, 9 aa, Homo Sapiens
RLLHFAHMF

SEQ ID NO: 1402116 - protein, 9 aa, Homo Sapiens
DHFGNMANN

SEQ ID NO: 1402117 - protein, 9 aa, Homo Sapiens
KECGEMFRL

SEQ ID NO: 1402118 - protein, 9 aa, Homo Sapiens
ARVVRCRET

SEQ ID NO: 1402119 - protein, 9 aa, Homo Sapiens
SDLEVNVEA

SEQ ID NO: 1402120 - protein, 9 aa, Homo Sapiens
PPHQMKCLT

SEQ ID NO: 1402121 - protein, 9 aa, Homo Sapiens
DGCYWCRSN

SEQ ID NO: 1402122 - protein, 9 aa, Homo Sapiens
IHPTNANLT

SEQ ID NO: 1402123 - protein, 9 aa, Homo Sapiens
RSRARTRWT

SEQ ID NO: 1402124 - protein, 9 aa, Homo Sapiens
KPYEFNVCG

SEQ ID NO: 1402125 - protein, 9 aa, Homo Sapiens
LISKFGDLF

SEQ ID NO: 1402126 - protein, 9 aa, Homo Sapiens
PPLRRLIIF

SEQ ID NO: 1402127 - protein, 9 aa, Homo Sapiens
DVIDKDTPI

SEQ ID NO: 1402128 - protein, 9 aa, Homo Sapiens
GDCPKRPEQ

SEQ ID NO: 1402129 - protein, 9 aa, Homo Sapiens
LHALEKSYK

SEQ ID NO: 1402130 - protein, 9 aa, Homo Sapiens
RQSCCLPGL

SEQ ID NO: 1402131 - protein, 9 aa, Homo Sapiens
SWGPSTPSC

SEQ ID NO: 1402132 - protein, 9 aa, Homo Sapiens
AKKWVLRKA

SEQ ID NO: 1402133 - protein, 9 aa, Homo Sapiens
KWITHLDRL

SEQ ID NO: 1402134 - protein, 9 aa, Homo Sapiens
VTLYKELRG

SEQ ID NO: 1402135 - protein, 9 aa, Homo Sapiens
NIGAGRPIK

SEQ ID NO: 1402136 - protein, 9 aa, Homo Sapiens
VATELNIRE

SEQ ID NO: 1402137 - protein, 9 aa, Homo Sapiens
FFCLRGHPS

SEQ ID NO: 1402138 - protein, 9 aa, Homo Sapiens
SALSCASSG

SEQ ID NO: 1402139 - protein, 9 aa, Homo Sapiens
RSESMWRQC

SEQ ID NO: 1402140 - protein, 9 aa, Homo Sapiens
LALLGASAP

SEQ ID NO: 1402141 - protein, 9 aa, Homo Sapiens
RQFHADFTS

SEQ ID NO: 1402142 - protein, 9 aa, Homo Sapiens
LAAWDAPCP

SEQ ID NO: 1402143 - protein, 9 aa, Homo Sapiens
LPPGPPWGL

SEQ ID NO: 1402144 - protein, 9 aa, Homo Sapiens
VHSPHLAMA

SEQ ID NO: 1402145 - protein, 9 aa, Homo Sapiens
KRPSLHRYL

SEQ ID NO: 1402146 - protein, 9 aa, Homo Sapiens
VLSHRSLYF

SEQ ID NO: 1402147 - protein, 9 aa, Homo Sapiens
GPDPPTGIG

SEQ ID NO: 1402148 - protein, 9 aa, Homo Sapiens
SSGASAAAA

SEQ ID NO: 1402149 - protein, 9 aa, Homo Sapiens
KERQRRKKL

SEQ ID NO: 1402150 - protein, 9 aa, Homo Sapiens
FNDPFFMVE

SEQ ID NO: 1402151 - protein, 9 aa, Homo Sapiens
APLLAVSAA

SEQ ID NO: 1402152 - protein, 9 aa, Homo Sapiens
HGERDCRDN

SEQ ID NO: 1402153 - protein, 9 aa, Homo Sapiens
HCIAELRFL

SEQ ID NO: 1402154 - protein, 9 aa, Homo Sapiens
VVCEQNLRP

SEQ ID NO: 1402155 - protein, 9 aa, Homo Sapiens
KRYRYVYHG

SEQ ID NO: 1402156 - protein, 9 aa, Homo Sapiens
MEPVWHVWT

SEQ ID NO: 1402157 - protein, 9 aa, Homo Sapiens
TGEKPYEFN

SEQ ID NO: 1402158 - protein, 9 aa, Homo Sapiens
MSQSGSPIG

SEQ ID NO: 1402159 - protein, 9 aa, Homo Sapiens
AADRMPQFS

SEQ ID NO: 1402160 - protein, 9 aa, Homo Sapiens
AVLVLIGLH

SEQ ID NO: 1402161 - protein, 9 aa, Homo Sapiens
CVVLKSSEI

SEQ ID NO: 1402162 - protein, 9 aa, Homo Sapiens
MFAALSTPS

SEQ ID NO: 1402163 - protein, 9 aa, Homo Sapiens
AELRFLCVL

SEQ ID NO: 1402164 - protein, 9 aa, Homo Sapiens
KRPEQLPQH

SEQ ID NO: 1402165 - protein, 9 aa, Homo Sapiens
LDQFSAFPV

SEQ ID NO: 1402166 - protein, 9 aa, Homo Sapiens
VFYNEILKR

SEQ ID NO: 1402167 - protein, 9 aa, Homo Sapiens
VDWDVYHGQ

SEQ ID NO: 1402168 - protein, 9 aa, Homo Sapiens
QDPKGKGHR

SEQ ID NO: 1402169 - protein, 9 aa, Homo Sapiens
IHGSPFTAK

SEQ ID NO: 1402170 - protein, 9 aa, Homo Sapiens
NMPFIVSMR

SEQ ID NO: 1402171 - protein, 9 aa, Homo Sapiens
RADGERQNQ

SEQ ID NO: 1402172 - protein, 9 aa, Homo Sapiens
LGSLEELSR

SEQ ID NO: 1402173 - protein, 9 aa, Homo Sapiens
NATVVTMPV

SEQ ID NO: 1402174 - protein, 9 aa, Homo Sapiens
IFKGARYYV

SEQ ID NO: 1402175 - protein, 9 aa, Homo Sapiens
KVIEPVGNH

SEQ ID NO: 1402176 - protein, 9 aa, Homo Sapiens
VTSTGLFQE

SEQ ID NO: 1402177 - protein, 9 aa, Homo Sapiens
VVGKVCRRP

SEQ ID NO: 1402178 - protein, 9 aa, Homo Sapiens
TRPSGSFLS

SEQ ID NO: 1402179 - protein, 9 aa, Homo Sapiens
LMTICGLTR

SEQ ID NO: 1402180 - protein, 9 aa, Homo Sapiens
PNRGVLRSL

SEQ ID NO: 1402181 - protein, 9 aa, Homo Sapiens
KEDNSNINP

SEQ ID NO: 1402182 - protein, 9 aa, Homo Sapiens
AKHHVLKMM

SEQ ID NO: 1402183 - protein, 9 aa, Homo Sapiens
RLQPPKALV

SEQ ID NO: 1402184 - protein, 9 aa, Homo Sapiens
QPQQWLQLV

SEQ ID NO: 1402185 - protein, 9 aa, Homo Sapiens
PHGPPMCGP

SEQ ID NO: 1402186 - protein, 9 aa, Homo Sapiens
QWPKEKSKH

SEQ ID NO: 1402187 - protein, 9 aa, Homo Sapiens
YLLCVRRKV

SEQ ID NO: 1402188 - protein, 9 aa, Homo Sapiens
EQLKLLHER

SEQ ID NO: 1402189 - protein, 9 aa, Homo Sapiens
DRMPQFSLG

SEQ ID NO: 1402190 - protein, 9 aa, Homo Sapiens
GPTRREDKV

SEQ ID NO: 1402191 - protein, 9 aa, Homo Sapiens
RMTRLHVTW

SEQ ID NO: 1402192 - protein, 9 aa, Homo Sapiens
AIQSHKLLN

SEQ ID NO: 1402193 - protein, 9 aa, Homo Sapiens
FSTLPVGPP

SEQ ID NO: 1402194 - protein, 9 aa, Homo Sapiens
TEAQVAEDR

SEQ ID NO: 1402195 - protein, 9 aa, Homo Sapiens
YLIHPTNAN

SEQ ID NO: 1402196 - protein, 9 aa, Homo Sapiens
TVQPQSPSH

SEQ ID NO: 1402197 - protein, 9 aa, Homo Sapiens
CIYPLSMCI

SEQ ID NO: 1402198 - protein, 9 aa, Homo Sapiens
GCYWCRSNR

SEQ ID NO: 1402199 - protein, 9 aa, Homo Sapiens
HSEDADVIC

SEQ ID NO: 1402200 - protein, 9 aa, Homo Sapiens
PQCTFFFLH

SEQ ID NO: 1402201 - protein, 9 aa, Homo Sapiens
AARLVASKS

SEQ ID NO: 1402202 - protein, 9 aa, Homo Sapiens
RNYYGNSLG

SEQ ID NO: 1402203 - protein, 9 aa, Homo Sapiens
FLVASLHTR

SEQ ID NO: 1402204 - protein, 9 aa, Homo Sapiens
DVPPPVLFK

SEQ ID NO: 1402205 - protein, 9 aa, Homo Sapiens
ARGSSPLPR

SEQ ID NO: 1402206 - protein, 9 aa, Homo Sapiens
AGAREAGRF

SEQ ID NO: 1402207 - protein, 9 aa, Homo Sapiens
MCVVCGSFA

SEQ ID NO: 1402208 - protein, 9 aa, Homo Sapiens
LQPPKALVK

SEQ ID NO: 1402209 - protein, 9 aa, Homo Sapiens
QMKCLTAVD

SEQ ID NO: 1402210 - protein, 9 aa, Homo Sapiens
IIGHISESP

SEQ ID NO: 1402211 - protein, 9 aa, Homo Sapiens
LVLLPGVLI

SEQ ID NO: 1402212 - protein, 9 aa, Homo Sapiens
MFGDEGVMC

SEQ ID NO: 1402213 - protein, 9 aa, Homo Sapiens
NMLERGEAE

SEQ ID NO: 1402214 - protein, 9 aa, Homo Sapiens
LHPQTLEQE

SEQ ID NO: 1402215 - protein, 9 aa, Homo Sapiens
RFHWVLSQP

SEQ ID NO: 1402216 - protein, 9 aa, Homo Sapiens
DDQGGAAQL

SEQ ID NO: 1402217 - protein, 9 aa, Homo Sapiens
VFILLHPAG

SEQ ID NO: 1402218 - protein, 9 aa, Homo Sapiens
ICFNSQSQA

SEQ ID NO: 1402219 - protein, 9 aa, Homo Sapiens
MTICGLTRP

SEQ ID NO: 1402220 - protein, 9 aa, Homo Sapiens
LFAVLKQLS

SEQ ID NO: 1402221 - protein, 9 aa, Homo Sapiens
YHGQGIQYL

SEQ ID NO: 1402222 - protein, 9 aa, Homo Sapiens
VLRPTTEHL

SEQ ID NO: 1402223 - protein, 9 aa, Homo Sapiens
GKNSPKKLR

SEQ ID NO: 1402224 - protein, 9 aa, Homo Sapiens
PYDCIRLSA

SEQ ID NO: 1402225 - protein, 9 aa, Homo Sapiens
IIRFAPQLV

SEQ ID NO: 1402226 - protein, 9 aa, Homo Sapiens
RHLMWMNMN

SEQ ID NO: 1402227 - protein, 9 aa, Homo Sapiens
TARFIVVFL

SEQ ID NO: 1402228 - protein, 9 aa, Homo Sapiens
NEDCLCTAL

SEQ ID NO: 1402229 - protein, 9 aa, Homo Sapiens
IGKVVLQVL

SEQ ID NO: 1402230 - protein, 9 aa, Homo Sapiens
CNEHFTPSC

SEQ ID NO: 1402231 - protein, 9 aa, Homo Sapiens
KIKGLTRCQ

SEQ ID NO: 1402232 - protein, 9 aa, Homo Sapiens
RRTPALTSL

SEQ ID NO: 1402233 - protein, 9 aa, Homo Sapiens
EPLFGASRV

SEQ ID NO: 1402234 - protein, 9 aa, Homo Sapiens
SSCCRPCCR

SEQ ID NO: 1402235 - protein, 9 aa, Homo Sapiens
QQLKETRIS

SEQ ID NO: 1402236 - protein, 9 aa, Homo Sapiens
NSDLIIRAK

SEQ ID NO: 1402237 - protein, 9 aa, Homo Sapiens
KVLGTDSSL

SEQ ID NO: 1402238 - protein, 9 aa, Homo Sapiens
LHFAHMFEF

SEQ ID NO: 1402239 - protein, 9 aa, Homo Sapiens
LALQGQTGN

SEQ ID NO: 1402240 - protein, 9 aa, Homo Sapiens
IHHSHALVS

SEQ ID NO: 1402241 - protein, 9 aa, Homo Sapiens
ICGLTRPES

SEQ ID NO: 1402242 - protein, 9 aa, Homo Sapiens
LVIVGHGHE

SEQ ID NO: 1402243 - protein, 9 aa, Homo Sapiens
KGPGRNYYG

SEQ ID NO: 1402244 - protein, 9 aa, Homo Sapiens
SKAWRASHM

SEQ ID NO: 1402245 - protein, 9 aa, Homo Sapiens
SGVALGAFG

SEQ ID NO: 1402246 - protein, 9 aa, Homo Sapiens
NLRDMHMQI

SEQ ID NO: 1402247 - protein, 9 aa, Homo Sapiens
KCLTAVDCL

SEQ ID NO: 1402248 - protein, 9 aa, Homo Sapiens
HNADYDLSA

SEQ ID NO: 1402249 - protein, 9 aa, Homo Sapiens
SARGSSPLP

SEQ ID NO: 1402250 - protein, 9 aa, Homo Sapiens
RYVRDIKIQ

SEQ ID NO: 1402251 - protein, 9 aa, Homo Sapiens
LEGDLQHAL

SEQ ID NO: 1402252 - protein, 9 aa, Homo Sapiens
CASHSGISL

SEQ ID NO: 1402253 - protein, 9 aa, Homo Sapiens
LKIFATCYL

SEQ ID NO: 1402254 - protein, 9 aa, Homo Sapiens
TLVWKFFLV

SEQ ID NO: 1402255 - protein, 9 aa, Homo Sapiens
CRLNKLPNQ

SEQ ID NO: 1402256 - protein, 9 aa, Homo Sapiens
VALQACLNL

SEQ ID NO: 1402257 - protein, 9 aa, Homo Sapiens
KKRQQDRMV

SEQ ID NO: 1402258 - protein, 9 aa, Homo Sapiens
CSIIGGTDQ

SEQ ID NO: 1402259 - protein, 9 aa, Homo Sapiens
FWKRKSTSW

SEQ ID NO: 1402260 - protein, 9 aa, Homo Sapiens
GRHSSSSNS

SEQ ID NO: 1402261 - protein, 9 aa, Homo Sapiens
WSWCGTSQT

SEQ ID NO: 1402262 - protein, 9 aa, Homo Sapiens
SSWRCFSFS

SEQ ID NO: 1402263 - protein, 9 aa, Homo Sapiens
ALTIFGIQS

SEQ ID NO: 1402264 - protein, 9 aa, Homo Sapiens
GTILAYCSL

SEQ ID NO: 1402265 - protein, 9 aa, Homo Sapiens
NNQHCLIEG

SEQ ID NO: 1402266 - protein, 9 aa, Homo Sapiens
LLDEKRVAQ

SEQ ID NO: 1402267 - protein, 9 aa, Homo Sapiens
LLAVSAALW

SEQ ID NO: 1402268 - protein, 9 aa, Homo Sapiens
INKALNKKW

SEQ ID NO: 1402269 - protein, 9 aa, Homo Sapiens
PQDNHEHQE

SEQ ID NO: 1402270 - protein, 9 aa, Homo Sapiens
TGKMIRRQT

SEQ ID NO: 1402271 - protein, 9 aa, Homo Sapiens
HNIVSIFTF

SEQ ID NO: 1402272 - protein, 9 aa, Homo Sapiens
SFARGAEGH

SEQ ID NO: 1402273 - protein, 9 aa, Homo Sapiens
SKSQTVGSM

SEQ ID NO: 1402274 - protein, 9 aa, Homo Sapiens
FQQTGVHGF

SEQ ID NO: 1402275 - protein, 9 aa, Homo Sapiens
VQWHKHSSL

SEQ ID NO: 1402276 - protein, 9 aa, Homo Sapiens
NSSIMVRIA

SEQ ID NO: 1402277 - protein, 9 aa, Homo Sapiens
SFLNPVLEM

SEQ ID NO: 1402278 - protein, 9 aa, Homo Sapiens
CEEFPLSGG

SEQ ID NO: 1402279 - protein, 9 aa, Homo Sapiens
YHRRLHALE

SEQ ID NO: 1402280 - protein, 9 aa, Homo Sapiens
LEHEGNFGA

SEQ ID NO: 1402281 - protein, 9 aa, Homo Sapiens
GASAPCGAA

SEQ ID NO: 1402282 - protein, 9 aa, Homo Sapiens
MRGEKRSKA

SEQ ID NO: 1402283 - protein, 9 aa, Homo Sapiens
IVGHGHEAE

SEQ ID NO: 1402284 - protein, 9 aa, Homo Sapiens
PVLVSSQFV

SEQ ID NO: 1402285 - protein, 9 aa, Homo Sapiens
SLVPCLRHI

SEQ ID NO: 1402286 - protein, 9 aa, Homo Sapiens
PTTEHLYFT

SEQ ID NO: 1402287 - protein, 9 aa, Homo Sapiens
SFFFCLRGH

SEQ ID NO: 1402288 - protein, 9 aa, Homo Sapiens
QLQKPPPSS

SEQ ID NO: 1402289 - protein, 9 aa, Homo Sapiens
WVLRPTTEH

SEQ ID NO: 1402290 - protein, 9 aa, Homo Sapiens
SLEELSREV

SEQ ID NO: 1402291 - protein, 9 aa, Homo Sapiens
GKWEQKKFM

SEQ ID NO: 1402292 - protein, 9 aa, Homo Sapiens
LHITQHQII

SEQ ID NO: 1402293 - protein, 9 aa, Homo Sapiens
RFAPQLVIK

SEQ ID NO: 1402294 - protein, 9 aa, Homo Sapiens
VFTLFLVMF

SEQ ID NO: 1402295 - protein, 9 aa, Homo Sapiens
RKDGCYWCR

SEQ ID NO: 1402296 - protein, 9 aa, Homo Sapiens
SLWLPRRRS

SEQ ID NO: 1402297 - protein, 9 aa, Homo Sapiens
DPKGKGHRR

SEQ ID NO: 1402298 - protein, 9 aa, Homo Sapiens
WATPQRSCV

SEQ ID NO: 1402299 - protein, 9 aa, Homo Sapiens
ADAHHDHNC

SEQ ID NO: 1402300 - protein, 9 aa, Homo Sapiens
GDGHGRLVI

SEQ ID NO: 1402301 - protein, 9 aa, Homo Sapiens
NLTFMGQLL

SEQ ID NO: 1402302 - protein, 9 aa, Homo Sapiens
VLQVLAEEP

SEQ ID NO: 1402303 - protein, 9 aa, Homo Sapiens
LRMLPLKQI

SEQ ID NO: 1402304 - protein, 9 aa, Homo Sapiens
DSPDGMPVI

SEQ ID NO: 1402305 - protein, 9 aa, Homo Sapiens
TVLTPFLGP

SEQ ID NO: 1402306 - protein, 9 aa, Homo Sapiens
VNCACASHS

SEQ ID NO: 1402307 - protein, 9 aa, Homo Sapiens
LDALLCHAL

SEQ ID NO: 1402308 - protein, 9 aa, Homo Sapiens
LEELNLGPC

SEQ ID NO: 1402309 - protein, 9 aa, Homo Sapiens
VWDDAVFIR

SEQ ID NO: 1402310 - protein, 9 aa, Homo Sapiens
GPPMCGPDP

SEQ ID NO: 1402311 - protein, 9 aa, Homo Sapiens
IATNVHPGV

SEQ ID NO: 1402312 - protein, 9 aa, Homo Sapiens
SAFNNLKNC

SEQ ID NO: 1402313 - protein, 9 aa, Homo Sapiens
TAQWAIPVD

SEQ ID NO: 1402314 - protein, 9 aa, Homo Sapiens
DLLHLDMAL

SEQ ID NO: 1402315 - protein, 9 aa, Homo Sapiens
TEGLARLCQ

SEQ ID NO: 1402316 - protein, 9 aa, Homo Sapiens
GTGEPSGSS

SEQ ID NO: 1402317 - protein, 9 aa, Homo Sapiens
PQRSCVCAG

SEQ ID NO: 1402318 - protein, 9 aa, Homo Sapiens
FIRCLMTHN

SEQ ID NO: 1402319 - protein, 9 aa, Homo Sapiens
LEATTSPGL

SEQ ID NO: 1402320 - protein, 9 aa, Homo Sapiens
YHGSQWMVA

SEQ ID NO: 1402321 - protein, 9 aa, Homo Sapiens
QLPQHALVC

SEQ ID NO: 1402322 - protein, 9 aa, Homo Sapiens
GIKELYEWD

SEQ ID NO: 1402323 - protein, 9 aa, Homo Sapiens
SCPYMAFVQ

SEQ ID NO: 1402324 - protein, 9 aa, Homo Sapiens
CLLQGLWRK

SEQ ID NO: 1402325 - protein, 9 aa, Homo Sapiens
KMGNFLAKG

SEQ ID NO: 1402326 - protein, 9 aa, Homo Sapiens
TKYPYVCHT

SEQ ID NO: 1402327 - protein, 9 aa, Homo Sapiens
GEMFRLYRH

SEQ ID NO: 1402328 - protein, 9 aa, Homo Sapiens
DIRAKKWVL

SEQ ID NO: 1402329 - protein, 9 aa, Homo Sapiens
CGAIVRPVA

SEQ ID NO: 1402330 - protein, 9 aa, Homo Sapiens
AWDAPCPLL

SEQ ID NO: 1402331 - protein, 9 aa, Homo Sapiens
HSLHITQHQ

SEQ ID NO: 1402332 - protein, 9 aa, Homo Sapiens
AIEHVQSLV

SEQ ID NO: 1402333 - protein, 9 aa, Homo Sapiens
CPIHQVRHM

SEQ ID NO: 1402334 - protein, 9 aa, Homo Sapiens
SLSFPGSSH

SEQ ID NO: 1402335 - protein, 9 aa, Homo Sapiens
FARGAEGHL

SEQ ID NO: 1402336 - protein, 9 aa, Homo Sapiens
QEKQLLGRS

SEQ ID NO: 1402337 - protein, 9 aa, Homo Sapiens
KCVLCTISF

SEQ ID NO: 1402338 - protein, 9 aa, Homo Sapiens
SETSSIVQK

SEQ ID NO: 1402339 - protein, 9 aa, Homo Sapiens
DHQSQEPSQ

SEQ ID NO: 1402340 - protein, 9 aa, Homo Sapiens
SQQQAPLQS

SEQ ID NO: 1402341 - protein, 9 aa, Homo Sapiens
HIPSIAGAG

SEQ ID NO: 1402342 - protein, 9 aa, Homo Sapiens
SKEIIAPLD

SEQ ID NO: 1402343 - protein, 9 aa, Homo Sapiens
MIRRQTVTQ

SEQ ID NO: 1402344 - protein, 9 aa, Homo Sapiens
VYDMQALHE

SEQ ID NO: 1402345 - protein, 9 aa, Homo Sapiens
TLLKYGVHK

SEQ ID NO: 1402346 - protein, 9 aa, Homo Sapiens
ATSTAASTP

SEQ ID NO: 1402347 - protein, 9 aa, Homo Sapiens
QDGITAGKA

SEQ ID NO: 1402348 - protein, 9 aa, Homo Sapiens
LPTLASRVA

SEQ ID NO: 1402349 - protein, 9 aa, Homo Sapiens
LGPDPPTGI

SEQ ID NO: 1402350 - protein, 9 aa, Homo Sapiens
NSREEAQQL

SEQ ID NO: 1402351 - protein, 9 aa, Homo Sapiens
EKEDNSNIN

SEQ ID NO: 1402352 - protein, 9 aa, Homo Sapiens
LTRCQAVVQ

SEQ ID NO: 1402353 - protein, 9 aa, Homo Sapiens
VLKQLSPVR

SEQ ID NO: 1402354 - protein, 9 aa, Homo Sapiens
DGSSIPLAG

SEQ ID NO: 1402355 - protein, 9 aa, Homo Sapiens
SCNICQICF

SEQ ID NO: 1402356 - protein, 9 aa, Homo Sapiens
YPQDNHEHQ

SEQ ID NO: 1402357 - protein, 9 aa, Homo Sapiens
RHYDHNHQE

SEQ ID NO: 1402358 - protein, 9 aa, Homo Sapiens
FALNAVDNL

SEQ ID NO: 1402359 - protein, 9 aa, Homo Sapiens
PPPHQMKCL

SEQ ID NO: 1402360 - protein, 9 aa, Homo Sapiens
LSYMVFMTS

SEQ ID NO: 1402361 - protein, 9 aa, Homo Sapiens
KALVKVKQP

SEQ ID NO: 1402362 - protein, 9 aa, Homo Sapiens
SNREVALQA

SEQ ID NO: 1402363 - protein, 9 aa, Homo Sapiens
GTKWVHVRC

SEQ ID NO: 1402364 - protein, 9 aa, Homo Sapiens
ISKEIIAPL

SEQ ID NO: 1402365 - protein, 9 aa, Homo Sapiens
KAQDVEPNH

SEQ ID NO: 1402366 - protein, 9 aa, Homo Sapiens
ASLLLQPSS

SEQ ID NO: 1402367 - protein, 9 aa, Homo Sapiens
YFGQSQRFL

SEQ ID NO: 1402368 - protein, 9 aa, Homo Sapiens
QAMAMVDIV

SEQ ID NO: 1402369 - protein, 9 aa, Homo Sapiens
AFCNSDLII

SEQ ID NO: 1402370 - protein, 9 aa, Homo Sapiens
TSSIVQKLK

SEQ ID NO: 1402371 - protein, 9 aa, Homo Sapiens
VSEKYLLAM

SEQ ID NO: 1402372 - protein, 9 aa, Homo Sapiens
GVFYNEILK

SEQ ID NO: 1402373 - protein, 9 aa, Homo Sapiens
EQGQQEEEL

SEQ ID NO: 1402374 - protein, 9 aa, Homo Sapiens
LTHPAHQPL

SEQ ID NO: 1402375 - protein, 9 aa, Homo Sapiens
SSETSSIVQ

SEQ ID NO: 1402376 - protein, 9 aa, Homo Sapiens
LLLPGTPKL

SEQ ID NO: 1402377 - protein, 9 aa, Homo Sapiens
HMMTFFIFL

SEQ ID NO: 1402378 - protein, 9 aa, Homo Sapiens
WDVYHGQGI

SEQ ID NO: 1402379 - protein, 9 aa, Homo Sapiens
GLWRKVQSL

SEQ ID NO: 1402380 - protein, 9 aa, Homo Sapiens
CPDDQGGAA

SEQ ID NO: 1402381 - protein, 9 aa, Homo Sapiens
EHHSCTPVP

SEQ ID NO: 1402382 - protein, 9 aa, Homo Sapiens
MGNSLIECS

SEQ ID NO: 1402383 - protein, 9 aa, Homo Sapiens
GTTASSPEC

SEQ ID NO: 1402384 - protein, 9 aa, Homo Sapiens
QEGRLLGSL

SEQ ID NO: 1402385 - protein, 9 aa, Homo Sapiens
CRIGFSLAK

SEQ ID NO: 1402386 - protein, 9 aa, Homo Sapiens
TEALWHRAY

SEQ ID NO: 1402387 - protein, 9 aa, Homo Sapiens
KGISARGSS

SEQ ID NO: 1402388 - protein, 9 aa, Homo Sapiens
LEQEKQLLG

SEQ ID NO: 1402389 - protein, 9 aa, Homo Sapiens
TTGMLANLH

SEQ ID NO: 1402390 - protein, 9 aa, Homo Sapiens
NFGAVGALL

SEQ ID NO: 1402391 - protein, 9 aa, Homo Sapiens
SHLPTLASR

SEQ ID NO: 1402392 - protein, 9 aa, Homo Sapiens
LGRSWKLLN

SEQ ID NO: 1402393 - protein, 9 aa, Homo Sapiens
RGLWLMSPN

SEQ ID NO: 1402394 - protein, 9 aa, Homo Sapiens
ERLCANLMQ

SEQ ID NO: 1402395 - protein, 9 aa, Homo Sapiens
FWLIKPQWK

SEQ ID NO: 1402396 - protein, 9 aa, Homo Sapiens
QEAATKPLP

SEQ ID NO: 1402397 - protein, 9 aa, Homo Sapiens
HVVGKVCRR

SEQ ID NO: 1402398 - protein, 9 aa, Homo Sapiens
VALTIFGIQ

SEQ ID NO: 1402399 - protein, 9 aa, Homo Sapiens
VCGRHSSSS

SEQ ID NO: 1402400 - protein, 9 aa, Homo Sapiens
LLGCLWSGP

SEQ ID NO: 1402401 - protein, 9 aa, Homo Sapiens
FLVKRPSLH

SEQ ID NO: 1402402 - protein, 9 aa, Homo Sapiens
QNPQVVPAA

SEQ ID NO: 1402403 - protein, 9 aa, Homo Sapiens
QNFALTKHH

SEQ ID NO: 1402404 - protein, 9 aa, Homo Sapiens
PLEIALTIS

SEQ ID NO: 1402405 - protein, 9 aa, Homo Sapiens
LGKQVLAGH

SEQ ID NO: 1402406 - protein, 9 aa, Homo Sapiens
VPVHLVLLP

SEQ ID NO: 1402407 - protein, 9 aa, Homo Sapiens
DWAEVYVVA

SEQ ID NO: 1402408 - protein, 9 aa, Homo Sapiens
KLWDLASVT

SEQ ID NO: 1402409 - protein, 9 aa, Homo Sapiens
HRFHWVLSQ

SEQ ID NO: 1402410 - protein, 9 aa, Homo Sapiens
VGRQNHKVV

SEQ ID NO: 1402411 - protein, 9 aa, Homo Sapiens
QNKPRSESM

SEQ ID NO: 1402412 - protein, 9 aa, Homo Sapiens
GRPIKRSLE

SEQ ID NO: 1402413 - protein, 9 aa, Homo Sapiens
FMRHGCHMV

SEQ ID NO: 1402414 - protein, 9 aa, Homo Sapiens
CVAQVYFFH

SEQ ID NO: 1402415 - protein, 9 aa, Homo Sapiens
SSWPEEAVG

SEQ ID NO: 1402416 - protein, 9 aa, Homo Sapiens
DWEVQRTML

SEQ ID NO: 1402417 - protein, 9 aa, Homo Sapiens
GHEAKPHSC

SEQ ID NO: 1402418 - protein, 9 aa, Homo Sapiens
QDKQKKRQQ

SEQ ID NO: 1402419 - protein, 9 aa, Homo Sapiens
VQRGQLPGL

SEQ ID NO: 1402420 - protein, 9 aa, Homo Sapiens
RWSARSRAR

SEQ ID NO: 1402421 - protein, 9 aa, Homo Sapiens
GPNQILPAA

SEQ ID NO: 1402422 - protein, 9 aa, Homo Sapiens
NHEEKILNR

SEQ ID NO: 1402423 - protein, 9 aa, Homo Sapiens
CLTAVDCLQ

SEQ ID NO: 1402424 - protein, 9 aa, Homo Sapiens
GPAGTGKTK

SEQ ID NO: 1402425 - protein, 9 aa, Homo Sapiens
HQSQEPSQF

SEQ ID NO: 1402426 - protein, 9 aa, Homo Sapiens
PQNIGAGRP

SEQ ID NO: 1402427 - protein, 9 aa, Homo Sapiens
IRAKKWVLR

SEQ ID NO: 1402428 - protein, 9 aa, Homo Sapiens
LRVATELNI

SEQ ID NO: 1402429 - protein, 9 aa, Homo Sapiens
RQQDRMVER

SEQ ID NO: 1402430 - protein, 9 aa, Homo Sapiens
VRPVATSVA

SEQ ID NO: 1402431 - protein, 9 aa, Homo Sapiens
ASTPSSTHA

SEQ ID NO: 1402432 - protein, 9 aa, Homo Sapiens
LVFSFFFCL

SEQ ID NO: 1402433 - protein, 9 aa, Homo Sapiens
AATKPLPTN

SEQ ID NO: 1402434 - protein, 9 aa, Homo Sapiens
ICGHAGTHQ

SEQ ID NO: 1402435 - protein, 9 aa, Homo Sapiens
ISFAIHQED

SEQ ID NO: 1402436 - protein, 9 aa, Homo Sapiens
EREREQFLV

SEQ ID NO: 1402437 - protein, 9 aa, Homo Sapiens
MSFLNPVLE

SEQ ID NO: 1402438 - protein, 9 aa, Homo Sapiens
QRTIGKNSP

SEQ ID NO: 1402439 - protein, 9 aa, Homo Sapiens
FLVALTIFG

SEQ ID NO: 1402440 - protein, 9 aa, Homo Sapiens
PTSAASWAT

SEQ ID NO: 1402441 - protein, 9 aa, Homo Sapiens
LFLRLDVFI

SEQ ID NO: 1402442 - protein, 9 aa, Homo Sapiens
KIALNTPQL

SEQ ID NO: 1402443 - protein, 9 aa, Homo Sapiens
LAKHHVLKM

SEQ ID NO: 1402444 - protein, 9 aa, Homo Sapiens
DVMKLLLFL

SEQ ID NO: 1402445 - protein, 9 aa, Homo Sapiens
GERQNQEYQ

SEQ ID NO: 1402446 - protein, 9 aa, Homo Sapiens
YAVENEHVN

SEQ ID NO: 1402447 - protein, 9 aa, Homo Sapiens
LRGHPSAFN

SEQ ID NO: 1402448 - protein, 9 aa, Homo Sapiens
STLKPPTPC

SEQ ID NO: 1402449 - protein, 9 aa, Homo Sapiens
PALKIFATC

SEQ ID NO: 1402450 - protein, 9 aa, Homo Sapiens
YMVFMTSSP

SEQ ID NO: 1402451 - protein, 9 aa, Homo Sapiens
SAAELRNFH

SEQ ID NO: 1402452 - protein, 9 aa, Homo Sapiens
AAELRNFHR

SEQ ID NO: 1402453 - protein, 9 aa, Homo Sapiens
LWLPRRRST

SEQ ID NO: 1402454 - protein, 9 aa, Homo Sapiens
AEMTGLGKQ

SEQ ID NO: 1402455 - protein, 9 aa, Homo Sapiens
LKNCIYPLS

SEQ ID NO: 1402456 - protein, 9 aa, Homo Sapiens
VVLKSSEIS

SEQ ID NO: 1402457 - protein, 9 aa, Homo Sapiens
HLRKEKHNA

SEQ ID NO: 1402458 - protein, 9 aa, Homo Sapiens
GNNELIMDQ

SEQ ID NO: 1402459 - protein, 9 aa, Homo Sapiens
SPNFAQVTS

SEQ ID NO: 1402460 - protein, 9 aa, Homo Sapiens
GSTDTSKHI

SEQ ID NO: 1402461 - protein, 9 aa, Homo Sapiens
FFQAESKYT

SEQ ID NO: 1402462 - protein, 9 aa, Homo Sapiens
VEAADRMPQ

SEQ ID NO: 1402463 - protein, 9 aa, Homo Sapiens
FAHMFEFFD

SEQ ID NO: 1402464 - protein, 9 aa, Homo Sapiens
YGIGLSAET

SEQ ID NO: 1402465 - protein, 9 aa, Homo Sapiens
QNISEGLVM

SEQ ID NO: 1402466 - protein, 9 aa, Homo Sapiens
SAALWPLGG

SEQ ID NO: 1402467 - protein, 9 aa, Homo Sapiens
TSLRLLCSI

SEQ ID NO: 1402468 - protein, 9 aa, Homo Sapiens
KNLFKWARE

SEQ ID NO: 1402469 - protein, 9 aa, Homo Sapiens
LVALTIFGI

SEQ ID NO: 1402470 - protein, 9 aa, Homo Sapiens
KGLTRCQAV

SEQ ID NO: 1402471 - protein, 9 aa, Homo Sapiens
WDKDLRVSE

SEQ ID NO: 1402472 - protein, 9 aa, Homo Sapiens
VGPSCLKQD

SEQ ID NO: 1402473 - protein, 9 aa, Homo Sapiens
ISHTGMEHS

SEQ ID NO: 1402474 - protein, 9 aa, Homo Sapiens
WHLCVQELG

SEQ ID NO: 1402475 - protein, 9 aa, Homo Sapiens
LHRYLSLCI

SEQ ID NO: 1402476 - protein, 9 aa, Homo Sapiens
NLERLHLAK

SEQ ID NO: 1402477 - protein, 9 aa, Homo Sapiens
FESHHQGFG

SEQ ID NO: 1402478 - protein, 9 aa, Homo Sapiens
STPSSTHAP

SEQ ID NO: 1402479 - protein, 9 aa, Homo Sapiens
EADSLTYNI

SEQ ID NO: 1402480 - protein, 9 aa, Homo Sapiens
ALQACLNLR

SEQ ID NO: 1402481 - protein, 9 aa, Homo Sapiens
SSNNSKPME

SEQ ID NO: 1402482 - protein, 9 aa, Homo Sapiens
AMSFLNPVL

SEQ ID NO: 1402483 - protein, 9 aa, Homo Sapiens
ILLHPAGVF

SEQ ID NO: 1402484 - protein, 9 aa, Homo Sapiens
EFDGGIVMG

SEQ ID NO: 1402485 - protein, 9 aa, Homo Sapiens
FPGSSHLPT

SEQ ID NO: 1402486 - protein, 9 aa, Homo Sapiens
PKLLCRQML

SEQ ID NO: 1402487 - protein, 9 aa, Homo Sapiens
GEDGPTVPP

SEQ ID NO: 1402488 - protein, 9 aa, Homo Sapiens
AAAAAAADA

SEQ ID NO: 1402489 - protein, 9 aa, Homo Sapiens
SGQNLEEDI

SEQ ID NO: 1402490 - protein, 9 aa, Homo Sapiens
CAVLLPASW

SEQ ID NO: 1402491 - protein, 9 aa, Homo Sapiens
FISEAEKKA

SEQ ID NO: 1402492 - protein, 9 aa, Homo Sapiens
TDIRAKKWV

SEQ ID NO: 1402493 - protein, 9 aa, Homo Sapiens
KEATICQNN

SEQ ID NO: 1402494 - protein, 9 aa, Homo Sapiens
AARVLSPTL

SEQ ID NO: 1402495 - protein, 9 aa, Homo Sapiens
RCFSFSGHP

SEQ ID NO: 1402496 - protein, 9 aa, Homo Sapiens
PVLFLDLMT

SEQ ID NO: 1402497 - protein, 9 aa, Homo Sapiens
TCYHQAASD

SEQ ID NO: 1402498 - protein, 9 aa, Homo Sapiens
GNLERLHLA

SEQ ID NO: 1402499 - protein, 9 aa, Homo Sapiens
SILFLIVHV

SEQ ID NO: 1402500 - protein, 9 aa, Homo Sapiens
FGRHYDHNH

SEQ ID NO: 1402501 - protein, 9 aa, Homo Sapiens
QPAFGGAEG

SEQ ID NO: 1402502 - protein, 9 aa, Homo Sapiens
IAELRFLCV

SEQ ID NO: 1402503 - protein, 9 aa, Homo Sapiens
IQLYHRFHW

SEQ ID NO: 1402504 - protein, 9 aa, Homo Sapiens
QVVMLHINC

SEQ ID NO: 1402505 - protein, 9 aa, Homo Sapiens
GVMCLNGNW

SEQ ID NO: 1402506 - protein, 9 aa, Homo Sapiens
HNCRSAGDD

SEQ ID NO: 1402507 - protein, 9 aa, Homo Sapiens
GGLDDRSPQ

SEQ ID NO: 1402508 - protein, 9 aa, Homo Sapiens
GTGKTKTVK

SEQ ID NO: 1402509 - protein, 9 aa, Homo Sapiens
TGLGKQVLA

SEQ ID NO: 1402510 - protein, 9 aa, Homo Sapiens
PTSPSLASC

SEQ ID NO: 1402511 - protein, 9 aa, Homo Sapiens
EKIFYLIHP

SEQ ID NO: 1402512 - protein, 9 aa, Homo Sapiens
LLNGIRTME

SEQ ID NO: 1402513 - protein, 9 aa, Homo Sapiens
ALTISPFST

SEQ ID NO: 1402514 - protein, 9 aa, Homo Sapiens
TVNLLSSNR

SEQ ID NO: 1402515 - protein, 9 aa, Homo Sapiens
DALPPGPPW

SEQ ID NO: 1402516 - protein, 9 aa, Homo Sapiens
EILRDSTNF

SEQ ID NO: 1402517 - protein, 9 aa, Homo Sapiens
ASWATPQRS

SEQ ID NO: 1402518 - protein, 9 aa, Homo Sapiens
QQAMAMVDI

SEQ ID NO: 1402519 - protein, 9 aa, Homo Sapiens
ANIPNMDTG

SEQ ID NO: 1402520 - protein, 9 aa, Homo Sapiens
SCVCAGPSW

SEQ ID NO: 1402521 - protein, 9 aa, Homo Sapiens
SSIICLSAE

SEQ ID NO: 1402522 - protein, 9 aa, Homo Sapiens
HLHSIKIVY

SEQ ID NO: 1402523 - protein, 9 aa, Homo Sapiens
RVENEDPLV

SEQ ID NO: 1402524 - protein, 9 aa, Homo Sapiens
HKVVNHSND

SEQ ID NO: 1402525 - protein, 9 aa, Homo Sapiens
EIIAPLDER

SEQ ID NO: 1402526 - protein, 9 aa, Homo Sapiens
LKDQKPKNK

SEQ ID NO: 1402527 - protein, 9 aa, Homo Sapiens
DGGIVMGSD

SEQ ID NO: 1402528 - protein, 9 aa, Homo Sapiens
SAASWATPQ

SEQ ID NO: 1402529 - protein, 9 aa, Homo Sapiens
QSCCLPGLT

SEQ ID NO: 1402530 - protein, 9 aa, Homo Sapiens
DSGLFEAAR

SEQ ID NO: 1402531 - protein, 9 aa, Homo Sapiens
KMRPISGVA

SEQ ID NO: 1402532 - protein, 9 aa, Homo Sapiens
NIITPPPHQ

SEQ ID NO: 1402533 - protein, 9 aa, Homo Sapiens
ENSRTQQSN

SEQ ID NO: 1402534 - protein, 9 aa, Homo Sapiens
AKKLHPQTL

SEQ ID NO: 1402535 - protein, 9 aa, Homo Sapiens
SQHASGNTF

SEQ ID NO: 1402536 - protein, 9 aa, Homo Sapiens
AGTGKTKTV

SEQ ID NO: 1402537 - protein, 9 aa, Homo Sapiens
LVGLTDEIN

SEQ ID NO: 1402538 - protein, 9 aa, Homo Sapiens
RKQQEERLQ

SEQ ID NO: 1402539 - protein, 9 aa, Homo Sapiens
NAVDNLVVV

SEQ ID NO: 1402540 - protein, 9 aa, Homo Sapiens
LKMMFWLIK

SEQ ID NO: 1402541 - protein, 9 aa, Homo Sapiens
KDHVRQFLL

SEQ ID NO: 1402542 - protein, 9 aa, Homo Sapiens
GQQERDQAK

SEQ ID NO: 1402543 - protein, 9 aa, Homo Sapiens
CRRPENNYY

SEQ ID NO: 1402544 - protein, 9 aa, Homo Sapiens
ATASTRPQD

SEQ ID NO: 1402545 - protein, 9 aa, Homo Sapiens
GLFEAARVL

SEQ ID NO: 1402546 - protein, 9 aa, Homo Sapiens
RLHALEKSY

SEQ ID NO: 1402547 - protein, 9 aa, Homo Sapiens
TPQPMPPCS

SEQ ID NO: 1402548 - protein, 9 aa, Homo Sapiens
FIRHRKVYT

SEQ ID NO: 1402549 - protein, 9 aa, Homo Sapiens
VVPVHLVLL

SEQ ID NO: 1402550 - protein, 9 aa, Homo Sapiens
GTSPVKGLW

SEQ ID NO: 1402551 - protein, 9 aa, Homo Sapiens
VHVRCALWI

SEQ ID NO: 1402552 - protein, 9 aa, Homo Sapiens
ALFLEHEGN

SEQ ID NO: 1402553 - protein, 9 aa, Homo Sapiens
LLHLDMALR

SEQ ID NO: 1402554 - protein, 9 aa, Homo Sapiens
LSSLWESLE

SEQ ID NO: 1402555 - protein, 9 aa, Homo Sapiens
DNSSIMVRI

SEQ ID NO: 1402556 - protein, 9 aa, Homo Sapiens
VSKKAHPLR

SEQ ID NO: 1402557 - protein, 9 aa, Homo Sapiens
FHERLKCYE

SEQ ID NO: 1402558 - protein, 9 aa, Homo Sapiens
LHPCRLNKL

SEQ ID NO: 1402559 - protein, 9 aa, Homo Sapiens
QHLCNEHFT

SEQ ID NO: 1402560 - protein, 9 aa, Homo Sapiens
CNQYEEKVR

SEQ ID NO: 1402561 - protein, 9 aa, Homo Sapiens
GNYNLLPHG

SEQ ID NO: 1402562 - protein, 9 aa, Homo Sapiens
FGKHVPRVV

SEQ ID NO: 1402563 - protein, 9 aa, Homo Sapiens
VPRVVHITM

SEQ ID NO: 1402564 - protein, 9 aa, Homo Sapiens
CLTRIRDRN

SEQ ID NO: 1402565 - protein, 9 aa, Homo Sapiens
DMALRQEKH

SEQ ID NO: 1402566 - protein, 9 aa, Homo Sapiens
HSSSSNSNR

SEQ ID NO: 1402567 - protein, 9 aa, Homo Sapiens
SMKDGKWEQ

SEQ ID NO: 1402568 - protein, 9 aa, Homo Sapiens
DTYLGQFPN

SEQ ID NO: 1402569 - protein, 9 aa, Homo Sapiens
IYMLDEHLE

SEQ ID NO: 1402570 - protein, 9 aa, Homo Sapiens
IVTVVAGLD

SEQ ID NO: 1402571 - protein, 9 aa, Homo Sapiens
PFSTVCRES

SEQ ID NO: 1402572 - protein, 9 aa, Homo Sapiens
ECGEMFRLY

SEQ ID NO: 1402573 - protein, 9 aa, Homo Sapiens
LVSSQFVRL

SEQ ID NO: 1402574 - protein, 9 aa, Homo Sapiens
RKVYTEEKS

SEQ ID NO: 1402575 - protein, 9 aa, Homo Sapiens
CQSLGNSLK

SEQ ID NO: 1402576 - protein, 9 aa, Homo Sapiens
SLATVQPQS

SEQ ID NO: 1402577 - protein, 9 aa, Homo Sapiens
IYNHLLYSV

SEQ ID NO: 1402578 - protein, 9 aa, Homo Sapiens
ACPDDQGGA

SEQ ID NO: 1402579 - protein, 9 aa, Homo Sapiens
NPSYLEMTV

SEQ ID NO: 1402580 - protein, 9 aa, Homo Sapiens
SVTLYKELR

SEQ ID NO: 1402581 - protein, 9 aa, Homo Sapiens
PTECSLAIE

SEQ ID NO: 1402582 - protein, 9 aa, Homo Sapiens
LVVDWDVYH

SEQ ID NO: 1402583 - protein, 9 aa, Homo Sapiens
RALHKYYEN

SEQ ID NO: 1402584 - protein, 9 aa, Homo Sapiens
QEGGNNELI

SEQ ID NO: 1402585 - protein, 9 aa, Homo Sapiens
TTTKRYHQP

SEQ ID NO: 1402586 - protein, 9 aa, Homo Sapiens
AKPHSCPYM

SEQ ID NO: 1402587 - protein, 9 aa, Homo Sapiens
ELTNTLEIS

SEQ ID NO: 1402588 - protein, 9 aa, Homo Sapiens
HPLRLQPPK

SEQ ID NO: 1402589 - protein, 9 aa, Homo Sapiens
SCSHLISKF

SEQ ID NO: 1402590 - protein, 9 aa, Homo Sapiens
KKAQDVEPN

SEQ ID NO: 1402591 - protein, 9 aa, Homo Sapiens
ALKQMSLAG

SEQ ID NO: 1402592 - protein, 9 aa, Homo Sapiens
NQHCLIEGK

SEQ ID NO: 1402593 - protein, 9 aa, Homo Sapiens
MTHQEAATK

SEQ ID NO: 1402594 - protein, 9 aa, Homo Sapiens
VHKIIYTML

SEQ ID NO: 1402595 - protein, 9 aa, Homo Sapiens
PSAQRAEDS

SEQ ID NO: 1402596 - protein, 9 aa, Homo Sapiens
FFFQRNHYF

SEQ ID NO: 1402597 - protein, 9 aa, Homo Sapiens
ATPQRSCVC

SEQ ID NO: 1402598 - protein, 9 aa, Homo Sapiens
LPWRNQASN

SEQ ID NO: 1402599 - protein, 9 aa, Homo Sapiens
SSHRLRVLY

SEQ ID NO: 1402600 - protein, 9 aa, Homo Sapiens
ARRKQQEER

SEQ ID NO: 1402601 - protein, 9 aa, Homo Sapiens
GYWVLRPTT

SEQ ID NO: 1402602 - protein, 9 aa, Homo Sapiens
GQNPQVVPA

SEQ ID NO: 1402603 - protein, 9 aa, Homo Sapiens
LICGHAGTH

SEQ ID NO: 1402604 - protein, 9 aa, Homo Sapiens
GLHDNDSRL

SEQ ID NO: 1402605 - protein, 9 aa, Homo Sapiens
FNVCGKAFS

SEQ ID NO: 1402606 - protein, 9 aa, Homo Sapiens
ALKIFATCY

SEQ ID NO: 1402607 - protein, 9 aa, Homo Sapiens
KQLLGRSWK

SEQ ID NO: 1402608 - protein, 9 aa, Homo Sapiens
TELNAIMNK

SEQ ID NO: 1402609 - protein, 9 aa, Homo Sapiens
GVSGDLAPL

SEQ ID NO: 1402610 - protein, 9 aa, Homo Sapiens
YIWERFDNE

SEQ ID NO: 1402611 - protein, 9 aa, Homo Sapiens
LSFPGSSHL

SEQ ID NO: 1402612 - protein, 9 aa, Homo Sapiens
KMFPWMVTR

SEQ ID NO: 1402613 - protein, 9 aa, Homo Sapiens
ANPQPAFGG

SEQ ID NO: 1402614 - protein, 9 aa, Homo Sapiens
RRQTVTQPF

SEQ ID NO: 1402615 - protein, 9 aa, Homo Sapiens
AQEGRFGLL

SEQ ID NO: 1402616 - protein, 9 aa, Homo Sapiens
GPGKQKRED

SEQ ID NO: 1402617 - protein, 9 aa, Homo Sapiens
LDLMTICGL

SEQ ID NO: 1402618 - protein, 9 aa, Homo Sapiens
QLGDVRADG

SEQ ID NO: 1402619 - protein, 9 aa, Homo Sapiens
KRMESILQA

SEQ ID NO: 1402620 - protein, 9 aa, Homo Sapiens
DKNTYIHYE

SEQ ID NO: 1402621 - protein, 9 aa, Homo Sapiens
AFRDRNTRI

SEQ ID NO: 1402622 - protein, 9 aa, Homo Sapiens
RDQSETQEL

SEQ ID NO: 1402623 - protein, 9 aa, Homo Sapiens
EGKSDSSII

SEQ ID NO: 1402624 - protein, 9 aa, Homo Sapiens
LRCPSKKST

SEQ ID NO: 1402625 - protein, 9 aa, Homo Sapiens
WSARSRART

SEQ ID NO: 1402626 - protein, 9 aa, Homo Sapiens
PAPWLPMRS

SEQ ID NO: 1402627 - protein, 9 aa, Homo Sapiens
QPEELTNTL

SEQ ID NO: 1402628 - protein, 9 aa, Homo Sapiens
NTLEISNIV

SEQ ID NO: 1402629 - protein, 9 aa, Homo Sapiens
GVHHVAGQA

SEQ ID NO: 1402630 - protein, 9 aa, Homo Sapiens
TDDLDVGDC

SEQ ID NO: 1402631 - protein, 9 aa, Homo Sapiens
PVDLPTECS

SEQ ID NO: 1402632 - protein, 9 aa, Homo Sapiens
PVKGLWVLC

SEQ ID NO: 1402633 - protein, 9 aa, Homo Sapiens
SLLLQPSSL

SEQ ID NO: 1402634 - protein, 9 aa, Homo Sapiens
PIFHSGMLP

SEQ ID NO: 1402635 - protein, 9 aa, Homo Sapiens
KNTYIHYEL

SEQ ID NO: 1402636 - protein, 9 aa, Homo Sapiens
TFFFLHKEF

SEQ ID NO: 1402637 - protein, 9 aa, Homo Sapiens
VHLVLLPGV

SEQ ID NO: 1402638 - protein, 9 aa, Homo Sapiens
RCASLEPKN

SEQ ID NO: 1402639 - protein, 9 aa, Homo Sapiens
YLLLPGTPK

SEQ ID NO: 1402640 - protein, 9 aa, Homo Sapiens
IEDSLWTEA

SEQ ID NO: 1402641 - protein, 9 aa, Homo Sapiens
VETLLDEKR

SEQ ID NO: 1402642 - protein, 9 aa, Homo Sapiens
YIHYELDYI

SEQ ID NO: 1402643 - protein, 9 aa, Homo Sapiens
PFFMVETLC

SEQ ID NO: 1402644 - protein, 9 aa, Homo Sapiens
KYEEEINKH

SEQ ID NO: 1402645 - protein, 9 aa, Homo Sapiens
RGRTSILQD

SEQ ID NO: 1402646 - protein, 9 aa, Homo Sapiens
QMIQKVIQN

SEQ ID NO: 1402647 - protein, 9 aa, Homo Sapiens
LQVLAEEPE

SEQ ID NO: 1402648 - protein, 9 aa, Homo Sapiens
QARVVRCRE

SEQ ID NO: 1402649 - protein, 9 aa, Homo Sapiens
MHYGHQAPQ

SEQ ID NO: 1402650 - protein, 9 aa, Homo Sapiens
SDEVVAPVH

SEQ ID NO: 1402651 - protein, 9 aa, Homo Sapiens
GMEHSAPAW

SEQ ID NO: 1402652 - protein, 9 aa, Homo Sapiens
HETCAQTLG

SEQ ID NO: 1402653 - protein, 9 aa, Homo Sapiens
THQVQNAKR

SEQ ID NO: 1402654 - protein, 9 aa, Homo Sapiens
LAMSFLNPV

SEQ ID NO: 1402655 - protein, 9 aa, Homo Sapiens
IAPLDERML

SEQ ID NO: 1402656 - protein, 9 aa, Homo Sapiens
ARGLEATTS

SEQ ID NO: 1402657 - protein, 9 aa, Homo Sapiens
QNNEDCLCT

SEQ ID NO: 1402658 - protein, 9 aa, Homo Sapiens
ILNEHVELL

SEQ ID NO: 1402659 - protein, 9 aa, Homo Sapiens
LPFFHPSGR

SEQ ID NO: 1402660 - protein, 9 aa, Homo Sapiens
CSHLISKFG

SEQ ID NO: 1402661 - protein, 9 aa, Homo Sapiens
SILQDGITA

SEQ ID NO: 1402662 - protein, 9 aa, Homo Sapiens
AFGWFDAHG

SEQ ID NO: 1402663 - protein, 9 aa, Homo Sapiens
TTSEDAVGE

SEQ ID NO: 1402664 - protein, 9 aa, Homo Sapiens
ARSSSALSC

SEQ ID NO: 1402665 - protein, 9 aa, Homo Sapiens
QNGGVCHHI

SEQ ID NO: 1402666 - protein, 9 aa, Homo Sapiens
WARLPQRRL

SEQ ID NO: 1402667 - protein, 9 aa, Homo Sapiens
YRGLWLMSP

SEQ ID NO: 1402668 - protein, 9 aa, Homo Sapiens
WKQSTKLAM

SEQ ID NO: 1402669 - protein, 9 aa, Homo Sapiens
KDQKPKNKE

SEQ ID NO: 1402670 - protein, 9 aa, Homo Sapiens
QLYHRFHWV

SEQ ID NO: 1402671 - protein, 9 aa, Homo Sapiens
ITEAQVAED

SEQ ID NO: 1402672 - protein, 9 aa, Homo Sapiens
DLIIRAKFV

SEQ ID NO: 1402673 - protein, 9 aa, Homo Sapiens
GDRPHISSK

SEQ ID NO: 1402674 - protein, 9 aa, Homo Sapiens
PGPPWGLSP

SEQ ID NO: 1402675 - protein, 9 aa, Homo Sapiens
LGGPSLWAL

SEQ ID NO: 1402676 - protein, 9 aa, Homo Sapiens
ITQHQIIPT

SEQ ID NO: 1402677 - protein, 9 aa, Homo Sapiens
TEQPPHLPG

SEQ ID NO: 1402678 - protein, 9 aa, Homo Sapiens
APALRGESD

SEQ ID NO: 1402679 - protein, 9 aa, Homo Sapiens
LVIAVMALN

SEQ ID NO: 1402680 - protein, 9 aa, Homo Sapiens
SYMVFMTSS

SEQ ID NO: 1402681 - protein, 9 aa, Homo Sapiens
DLSRGILVL

SEQ ID NO: 1402682 - protein, 9 aa, Homo Sapiens
PESVLHANS

SEQ ID NO: 1402683 - protein, 9 aa, Homo Sapiens
SCNHGEVQC

SEQ ID NO: 1402684 - protein, 9 aa, Homo Sapiens
SENESTHNG

SEQ ID NO: 1402685 - protein, 9 aa, Homo Sapiens
HCFEARICA

SEQ ID NO: 1402686 - protein, 9 aa, Homo Sapiens
QLMFAALST

SEQ ID NO: 1402687 - protein, 9 aa, Homo Sapiens
SIPPAFRDR

SEQ ID NO: 1402688 - protein, 9 aa, Homo Sapiens
NKENIFVSI

SEQ ID NO: 1402689 - protein, 9 aa, Homo Sapiens
PDIHSSGLL

SEQ ID NO: 1402690 - protein, 9 aa, Homo Sapiens
RGRRQAKKL

SEQ ID NO: 1402691 - protein, 9 aa, Homo Sapiens
DDLDVGDCP

SEQ ID NO: 1402692 - protein, 9 aa, Homo Sapiens
AVAKKTIQC

SEQ ID NO: 1402693 - protein, 9 aa, Homo Sapiens
GDGQGRVVP

SEQ ID NO: 1402694 - protein, 9 aa, Homo Sapiens
PCKLEPEPC

SEQ ID NO: 1402695 - protein, 9 aa, Homo Sapiens
GPPWGLSPR

SEQ ID NO: 1402696 - protein, 9 aa, Homo Sapiens
DVGDCPKRP

SEQ ID NO: 1402697 - protein, 9 aa, Homo Sapiens
SSSSNSNRE

SEQ ID NO: 1402698 - protein, 9 aa, Homo Sapiens
KLAVLKDWA

SEQ ID NO: 1402699 - protein, 9 aa, Homo Sapiens
CSATPAPLL

SEQ ID NO: 1402700 - protein, 9 aa, Homo Sapiens
RFGQGVHHV

SEQ ID NO: 1402701 - protein, 9 aa, Homo Sapiens
YPYVCHTEL

SEQ ID NO: 1402702 - protein, 9 aa, Homo Sapiens
NCHNSKLTK

SEQ ID NO: 1402703 - protein, 9 aa, Homo Sapiens
AVSHRGCKA

SEQ ID NO: 1402704 - protein, 9 aa, Homo Sapiens
LTLRHLMWM

SEQ ID NO: 1402705 - protein, 9 aa, Homo Sapiens
LCTALSSYA

SEQ ID NO: 1402706 - protein, 9 aa, Homo Sapiens
DSLGGSHVV

SEQ ID NO: 1402707 - protein, 9 aa, Homo Sapiens
QCTFFFLHK

SEQ ID NO: 1402708 - protein, 9 aa, Homo Sapiens
HHVAGQAGN

SEQ ID NO: 1402709 - protein, 9 aa, Homo Sapiens
PQVVPAALL

SEQ ID NO: 1402710 - protein, 9 aa, Homo Sapiens
PNIKSRIAK

SEQ ID NO: 1402711 - protein, 9 aa, Homo Sapiens
VIQNIEQQK

SEQ ID NO: 1402712 - protein, 9 aa, Homo Sapiens
DGHGRLVIV

SEQ ID NO: 1402713 - protein, 9 aa, Homo Sapiens
DISENYHIP

SEQ ID NO: 1402714 - protein, 9 aa, Homo Sapiens
MLHINCKVN

SEQ ID NO: 1402715 - protein, 9 aa, Homo Sapiens
FQEKEGIVK

SEQ ID NO: 1402716 - protein, 9 aa, Homo Sapiens
KMMFWLIKP

SEQ ID NO: 1402717 - protein, 9 aa, Homo Sapiens
AFGGAEGQP

SEQ ID NO: 1402718 - protein, 9 aa, Homo Sapiens
YYLSIFMGL

SEQ ID NO: 1402719 - protein, 9 aa, Homo Sapiens
KTVKDLGKA

SEQ ID NO: 1402720 - protein, 9 aa, Homo Sapiens
NLKSLMETM

SEQ ID NO: 1402721 - protein, 9 aa, Homo Sapiens
MEHSAPAWM

SEQ ID NO: 1402722 - protein, 9 aa, Homo Sapiens
ESGAALFGD

SEQ ID NO: 1402723 - protein, 9 aa, Homo Sapiens
WERFDNETF

SEQ ID NO: 1402724 - protein, 9 aa, Homo Sapiens
GTHCGPYET

SEQ ID NO: 1402725 - protein, 9 aa, Homo Sapiens
TREGGWTNN

SEQ ID NO: 1402726 - protein, 9 aa, Homo Sapiens
AVQESNQKC

SEQ ID NO: 1402727 - protein, 9 aa, Homo Sapiens
NEADSLTYN

SEQ ID NO: 1402728 - protein, 9 aa, Homo Sapiens
KLAMSFLNP

SEQ ID NO: 1402729 - protein, 9 aa, Homo Sapiens
LVASLHTRT

SEQ ID NO: 1402730 - protein, 9 aa, Homo Sapiens
ESHHQGFGL

SEQ ID NO: 1402731 - protein, 9 aa, Homo Sapiens
LKMVTSTGL

SEQ ID NO: 1402732 - protein, 9 aa, Homo Sapiens
VNKSGTQRS

SEQ ID NO: 1402733 - protein, 9 aa, Homo Sapiens
MALRQEKHM

SEQ ID NO: 1402734 - protein, 9 aa, Homo Sapiens
RRARHDPPD

SEQ ID NO: 1402735 - protein, 9 aa, Homo Sapiens
TGEPSGSSS

SEQ ID NO: 1402736 - protein, 9 aa, Homo Sapiens
APQVAMLPK

SEQ ID NO: 1402737 - protein, 9 aa, Homo Sapiens
WDDAVFIRA

SEQ ID NO: 1402738 - protein, 9 aa, Homo Sapiens
QSHKLLNRP

SEQ ID NO: 1402739 - protein, 9 aa, Homo Sapiens
KIYFQSRLV

SEQ ID NO: 1402740 - protein, 9 aa, Homo Sapiens
LVIFYSLIC

SEQ ID NO: 1402741 - protein, 9 aa, Homo Sapiens
ALRGESDML

SEQ ID NO: 1402742 - protein, 9 aa, Homo Sapiens
SGSSSKIRT

SEQ ID NO: 1402743 - protein, 9 aa, Homo Sapiens
PTTGMLANL

SEQ ID NO: 1402744 - protein, 9 aa, Homo Sapiens
NNGYWVLRP

SEQ ID NO: 1402745 - protein, 9 aa, Homo Sapiens
STHAPARSS

SEQ ID NO: 1402746 - protein, 9 aa, Homo Sapiens
VALGAFGGA

SEQ ID NO: 1402747 - protein, 9 aa, Homo Sapiens
ESPSTKSCG

SEQ ID NO: 1402748 - protein, 9 aa, Homo Sapiens
KDYIWERFD

SEQ ID NO: 1402749 - protein, 9 aa, Homo Sapiens
HEHQEADAH

SEQ ID NO: 1402750 - protein, 9 aa, Homo Sapiens
QFLLTFQRE

SEQ ID NO: 1402751 - protein, 9 aa, Homo Sapiens
HWVLSQPQL

SEQ ID NO: 1402752 - protein, 9 aa, Homo Sapiens
QPAATASTR

SEQ ID NO: 1402753 - protein, 9 aa, Homo Sapiens
QLSRFAHPQ

SEQ ID NO: 1402754 - protein, 9 aa, Homo Sapiens
CPLLEGSAE

SEQ ID NO: 1402755 - protein, 9 aa, Homo Sapiens
RNYVWDDAV

SEQ ID NO: 1402756 - protein, 9 aa, Homo Sapiens
SDPEDERLC

SEQ ID NO: 1402757 - protein, 9 aa, Homo Sapiens
FKADQSESS

SEQ ID NO: 1402758 - protein, 9 aa, Homo Sapiens
IKPQWKQST

SEQ ID NO: 1402759 - protein, 9 aa, Homo Sapiens
MFRLYRHMC

SEQ ID NO: 1402760 - protein, 9 aa, Homo Sapiens
PNFAQVTST

SEQ ID NO: 1402761 - protein, 9 aa, Homo Sapiens
IMGQQRSFW

SEQ ID NO: 1402762 - protein, 9 aa, Homo Sapiens
NEGGRWKEK

SEQ ID NO: 1402763 - protein, 9 aa, Homo Sapiens
ALAQAIAVQ

SEQ ID NO: 1402764 - protein, 9 aa, Homo Sapiens
NSCPEVATP

SEQ ID NO: 1402765 - protein, 9 aa, Homo Sapiens
FLFLLLLTA

SEQ ID NO: 1402766 - protein, 9 aa, Homo Sapiens
IEDLELQIN

SEQ ID NO: 1402767 - protein, 9 aa, Homo Sapiens
CIEPLFGAS

SEQ ID NO: 1402768 - protein, 9 aa, Homo Sapiens
RQEFGGVAP

SEQ ID NO: 1402769 - protein, 9 aa, Homo Sapiens
TYLPDSCCH

SEQ ID NO: 1402770 - protein, 9 aa, Homo Sapiens
SLLWPAASV

SEQ ID NO: 1402771 - protein, 9 aa, Homo Sapiens
VASKSQTVG

SEQ ID NO: 1402772 - protein, 9 aa, Homo Sapiens
RSLGEPWRA

SEQ ID NO: 1402773 - protein, 9 aa, Homo Sapiens
LLCQLWMKI

SEQ ID NO: 1402774 - protein, 9 aa, Homo Sapiens
AISQHASGN

SEQ ID NO: 1402775 - protein, 9 aa, Homo Sapiens
WVLRKALEH

SEQ ID NO: 1402776 - protein, 9 aa, Homo Sapiens
ILNRHEYPL

SEQ ID NO: 1402777 - protein, 9 aa, Homo Sapiens
NAVASTLVW

SEQ ID NO: 1402778 - protein, 9 aa, Homo Sapiens
AQNPISQRS

SEQ ID NO: 1402779 - protein, 9 aa, Homo Sapiens
TESKKARSQ

SEQ ID NO: 1402780 - protein, 9 aa, Homo Sapiens
QTGVHGFAR

SEQ ID NO: 1402781 - protein, 9 aa, Homo Sapiens
RPTSRARQS

SEQ ID NO: 1402782 - protein, 9 aa, Homo Sapiens
AGDDCERVG

SEQ ID NO: 1402783 - protein, 9 aa, Homo Sapiens
SEAEKKAQD

SEQ ID NO: 1402784 - protein, 9 aa, Homo Sapiens
DLFRVVTLE

SEQ ID NO: 1402785 - protein, 9 aa, Homo Sapiens
RGLEATTSP

SEQ ID NO: 1402786 - protein, 9 aa, Homo Sapiens
SSVSPPQAA

SEQ ID NO: 1402787 - protein, 9 aa, Homo Sapiens
ITDDLDVGD

SEQ ID NO: 1402788 - protein, 9 aa, Homo Sapiens
YDCIRLSAE

SEQ ID NO: 1402789 - protein, 9 aa, Homo Sapiens
VSIFTFMGA

SEQ ID NO: 1402790 - protein, 9 aa, Homo Sapiens
ENTEEEEEA

SEQ ID NO: 1402791 - protein, 9 aa, Homo Sapiens
ARHHTREIF

SEQ ID NO: 1402792 - protein, 9 aa, Homo Sapiens
HQEDAKALW

SEQ ID NO: 1402793 - protein, 9 aa, Homo Sapiens
FEDFPQSLL

SEQ ID NO: 1402794 - protein, 9 aa, Homo Sapiens
FQSRLVCGR

SEQ ID NO: 1402795 - protein, 9 aa, Homo Sapiens
RSLYFGQSQ

SEQ ID NO: 1402796 - protein, 9 aa, Homo Sapiens
HTGMEHSAP

SEQ ID NO: 1402797 - protein, 9 aa, Homo Sapiens
MTGLGKQVL

SEQ ID NO: 1402798 - protein, 9 aa, Homo Sapiens
VPFLEILRR

SEQ ID NO: 1402799 - protein, 9 aa, Homo Sapiens
IYPLSMCIN

SEQ ID NO: 1402800 - protein, 9 aa, Homo Sapiens
IHLLYTESK

SEQ ID NO: 1402801 - protein, 9 aa, Homo Sapiens
RARHDPPDL

SEQ ID NO: 1402802 - protein, 9 aa, Homo Sapiens
RQAKKLHPQ

SEQ ID NO: 1402803 - protein, 9 aa, Homo Sapiens
YNDKHIHGS

SEQ ID NO: 1402804 - protein, 9 aa, Homo Sapiens
KVCRRPENN

SEQ ID NO: 1402805 - protein, 9 aa, Homo Sapiens
VLFLDLMTI

SEQ ID NO: 1402806 - protein, 9 aa, Homo Sapiens
LLWPAASVR

SEQ ID NO: 1402807 - protein, 9 aa, Homo Sapiens
LGTGEPSGS

SEQ ID NO: 1402808 - protein, 9 aa, Homo Sapiens
EQLPQHALV

SEQ ID NO: 1402809 - protein, 9 aa, Homo Sapiens
VIEPVGNHE

SEQ ID NO: 1402810 - protein, 9 aa, Homo Sapiens
IQEKLCLTR

SEQ ID NO: 1402811 - protein, 9 aa, Homo Sapiens
STLVWKFFL

SEQ ID NO: 1402812 - protein, 9 aa, Homo Sapiens
CASVAIGKL

SEQ ID NO: 1402813 - protein, 9 aa, Homo Sapiens
YEWDNRRET

SEQ ID NO: 1402814 - protein, 9 aa, Homo Sapiens
CYWCRSNRC

SEQ ID NO: 1402815 - protein, 9 aa, Homo Sapiens
MRKVVCEQN

SEQ ID NO: 1402816 - protein, 9 aa, Homo Sapiens
KRPFQCIVC

SEQ ID NO: 1402817 - protein, 9 aa, Homo Sapiens
ILLPALKIF

SEQ ID NO: 1402818 - protein, 9 aa, Homo Sapiens
PQQLKETRI

SEQ ID NO: 1402819 - protein, 9 aa, Homo Sapiens
QRGQLPGLL

SEQ ID NO: 1402820 - protein, 9 aa, Homo Sapiens
ASLQVVLEH

SEQ ID NO: 1402821 - protein, 9 aa, Homo Sapiens
FHADFTSLS

SEQ ID NO: 1402822 - protein, 9 aa, Homo Sapiens
QSLGNSLKQ

SEQ ID NO: 1402823 - protein, 9 aa, Homo Sapiens
HDQDRKSEE

SEQ ID NO: 1402824 - protein, 9 aa, Homo Sapiens
KITNEPTTG

SEQ ID NO: 1402825 - protein, 9 aa, Homo Sapiens
AVIVFELTC

SEQ ID NO: 1402826 - protein, 9 aa, Homo Sapiens
IFVVRFLSG

SEQ ID NO: 1402827 - protein, 9 aa, Homo Sapiens
GVSLVKVKF

SEQ ID NO: 1402828 - protein, 9 aa, Homo Sapiens
VLAGHGASL

SEQ ID NO: 1402829 - protein, 9 aa, Homo Sapiens
LPGASLLLQ

SEQ ID NO: 1402830 - protein, 9 aa, Homo Sapiens
VVNATVVTM

SEQ ID NO: 1402831 - protein, 9 aa, Homo Sapiens
NSVGTTSDI

SEQ ID NO: 1402832 - protein, 9 aa, Homo Sapiens
RKDHVRQFL

SEQ ID NO: 1402833 - protein, 9 aa, Homo Sapiens
YVKIHHSHA

SEQ ID NO: 1402834 - protein, 9 aa, Homo Sapiens
DFPQSLLQI

SEQ ID NO: 1402835 - protein, 9 aa, Homo Sapiens
PKRPFQCIV

SEQ ID NO: 1402836 - protein, 9 aa, Homo Sapiens
DLSYMVFMT

SEQ ID NO: 1402837 - protein, 9 aa, Homo Sapiens
SGWATSTAA

SEQ ID NO: 1402838 - protein, 9 aa, Homo Sapiens
IPSIAGAGA

SEQ ID NO: 1402839 - protein, 9 aa, Homo Sapiens
QNGQNPQVV

SEQ ID NO: 1402840 - protein, 9 aa, Homo Sapiens
PIGFAMYTT

SEQ ID NO: 1402841 - protein, 9 aa, Homo Sapiens
VTAIGATVI

SEQ ID NO: 1402842 - protein, 9 aa, Homo Sapiens
DISPGPTSP

SEQ ID NO: 1402843 - protein, 9 aa, Homo Sapiens
FPLSGGAGH

SEQ ID NO: 1402844 - protein, 9 aa, Homo Sapiens
NQDLTSLWL

SEQ ID NO: 1402845 - protein, 9 aa, Homo Sapiens
VITLISVSG

SEQ ID NO: 1402846 - protein, 9 aa, Homo Sapiens
NKALNKKWV

SEQ ID NO: 1402847 - protein, 9 aa, Homo Sapiens
LESRLVGLT

SEQ ID NO: 1402848 - protein, 9 aa, Homo Sapiens
AVLKDWAEV

SEQ ID NO: 1402849 - protein, 9 aa, Homo Sapiens
YGVHKIIYT

SEQ ID NO: 1402850 - protein, 9 aa, Homo Sapiens
PILLPALKI

SEQ ID NO: 1402851 - protein, 9 aa, Homo Sapiens
LEMTVSGAS

SEQ ID NO: 1402852 - protein, 9 aa, Homo Sapiens
SYGTFLCLC

SEQ ID NO: 1402853 - protein, 9 aa, Homo Sapiens
GRAAARWSA

SEQ ID NO: 1402854 - protein, 9 aa, Homo Sapiens
NKKWVWRIL

SEQ ID NO: 1402855 - protein, 9 aa, Homo Sapiens
MGQQRSFWK

SEQ ID NO: 1402856 - protein, 9 aa, Homo Sapiens
SWRKLTIFS

SEQ ID NO: 1402857 - protein, 9 aa, Homo Sapiens
SALRRSWRY

SEQ ID NO: 1402858 - protein, 9 aa, Homo Sapiens
GLEATTSPG

SEQ ID NO: 1402859 - protein, 9 aa, Homo Sapiens
GPTSAASWA

SEQ ID NO: 1402860 - protein, 9 aa, Homo Sapiens
NPRKSVVPA

SEQ ID NO: 1402861 - protein, 9 aa, Homo Sapiens
GVLIPHGPP

SEQ ID NO: 1402862 - protein, 9 aa, Homo Sapiens
ELRNFHRDL

SEQ ID NO: 1402863 - protein, 9 aa, Homo Sapiens
TRKIGLETI

SEQ ID NO: 1402864 - protein, 9 aa, Homo Sapiens
KSDSSIICL

SEQ ID NO: 1402865 - protein, 9 aa, Homo Sapiens
VGGEITDDL

SEQ ID NO: 1402866 - protein, 9 aa, Homo Sapiens
NLGPCDANT

SEQ ID NO: 1402867 - protein, 9 aa, Homo Sapiens
NPTEAELRG

SEQ ID NO: 1402868 - protein, 9 aa, Homo Sapiens
GPTVPPGPP

SEQ ID NO: 1402869 - protein, 9 aa, Homo Sapiens
LIHPTNANL

SEQ ID NO: 1402870 - protein, 9 aa, Homo Sapiens
PGTPKLMGS

SEQ ID NO: 1402871 - protein, 9 aa, Homo Sapiens
RDIKIQIEM

SEQ ID NO: 1402872 - protein, 9 aa, Homo Sapiens
FAHPQEILR

SEQ ID NO: 1402873 - protein, 9 aa, Homo Sapiens
QLVIKEDEL

SEQ ID NO: 1402874 - protein, 9 aa, Homo Sapiens
GLEGDLQHA

SEQ ID NO: 1402875 - protein, 9 aa, Homo Sapiens
WRASHMMTF

SEQ ID NO: 1402876 - protein, 9 aa, Homo Sapiens
REEEEGSTI

SEQ ID NO: 1402877 - protein, 9 aa, Homo Sapiens
AGSCVVLKS

SEQ ID NO: 1402878 - protein, 9 aa, Homo Sapiens
LAWVENALN

SEQ ID NO: 1402879 - protein, 9 aa, Homo Sapiens
RHGERDCRD

SEQ ID NO: 1402880 - protein, 9 aa, Homo Sapiens
NHTEFVITL

SEQ ID NO: 1402881 - protein, 9 aa, Homo Sapiens
PAASVRLDS

SEQ ID NO: 1402882 - protein, 9 aa, Homo Sapiens
KSKHGLFWA

SEQ ID NO: 1402883 - protein, 9 aa, Homo Sapiens
WAMFLDQPQ

SEQ ID NO: 1402884 - protein, 9 aa, Homo Sapiens
DGFLDDGRV

SEQ ID NO: 1402885 - protein, 9 aa, Homo Sapiens
HFDFSAQDP

SEQ ID NO: 1402886 - protein, 9 aa, Homo Sapiens
CQECDKVFE

SEQ ID NO: 1402887 - protein, 9 aa, Homo Sapiens
SGSSTGPST

SEQ ID NO: 1402888 - protein, 9 aa, Homo Sapiens
AGDGHGRLV

SEQ ID NO: 1402889 - protein, 9 aa, Homo Sapiens
LCHQGYELH

SEQ ID NO: 1402890 - protein, 9 aa, Homo Sapiens
LWLMSPNRG

SEQ ID NO: 1402891 - protein, 9 aa, Homo Sapiens
KVVNHSNDC

SEQ ID NO: 1402892 - protein, 9 aa, Homo Sapiens
TVVAGLDRE

SEQ ID NO: 1402893 - protein, 9 aa, Homo Sapiens
GGEITDDLD

SEQ ID NO: 1402894 - protein, 9 aa, Homo Sapiens
QVLGRHCFE

SEQ ID NO: 1402895 - protein, 9 aa, Homo Sapiens
CASSGASAA

SEQ ID NO: 1402896 - protein, 9 aa, Homo Sapiens
TVRTQRRRR

SEQ ID NO: 1402897 - protein, 9 aa, Homo Sapiens
GHLHSIKIV

SEQ ID NO: 1402898 - protein, 9 aa, Homo Sapiens
TVEHPDMKQ

SEQ ID NO: 1402899 - protein, 9 aa, Homo Sapiens
VPSDAQQAM

SEQ ID NO: 1402900 - protein, 9 aa, Homo Sapiens
EGVKEAQAP

SEQ ID NO: 1402901 - protein, 9 aa, Homo Sapiens
GVYTGNMAL

SEQ ID NO: 1402902 - protein, 9 aa, Homo Sapiens
PTGRGRAAA

SEQ ID NO: 1402903 - protein, 9 aa, Homo Sapiens
HVRCALWIP

SEQ ID NO: 1402904 - protein, 9 aa, Homo Sapiens
SAEYELEKH

SEQ ID NO: 1402905 - protein, 9 aa, Homo Sapiens
PTLSTLQQR

SEQ ID NO: 1402906 - protein, 9 aa, Homo Sapiens
PSWGPSTPS

SEQ ID NO: 1402907 - protein, 9 aa, Homo Sapiens
ISKFGDLFS

SEQ ID NO: 1402908 - protein, 9 aa, Homo Sapiens
LRNKEVKGP

SEQ ID NO: 1402909 - protein, 9 aa, Homo Sapiens
TVGVSGDLA

SEQ ID NO: 1402910 - protein, 9 aa, Homo Sapiens
ELNLGPCDA

SEQ ID NO: 1402911 - protein, 9 aa, Homo Sapiens
FMTSSPSYG

SEQ ID NO: 1402912 - protein, 9 aa, Homo Sapiens
PPWGLSPRK

SEQ ID NO: 1402913 - protein, 9 aa, Homo Sapiens
SHVYFFQAE

SEQ ID NO: 1402914 - protein, 9 aa, Homo Sapiens
VAIGKLALL

SEQ ID NO: 1402915 - protein, 9 aa, Homo Sapiens
AVKPKKTEG

SEQ ID NO: 1402916 - protein, 9 aa, Homo Sapiens
QFNLLGCLW

SEQ ID NO: 1402917 - protein, 9 aa, Homo Sapiens
LMLVALDRY

SEQ ID NO: 1402918 - protein, 9 aa, Homo Sapiens
YLINVVTNH

SEQ ID NO: 1402919 - protein, 9 aa, Homo Sapiens
ISGSEATSQ

SEQ ID NO: 1402920 - protein, 9 aa, Homo Sapiens
IQPNSREEA

SEQ ID NO: 1402921 - protein, 9 aa, Homo Sapiens
EEFPLSGGA

SEQ ID NO: 1402922 - protein, 9 aa, Homo Sapiens
PGQRDLFRV

SEQ ID NO: 1402923 - protein, 9 aa, Homo Sapiens
NGQNPQVVP

SEQ ID NO: 1402924 - protein, 9 aa, Homo Sapiens
HALPFFLLF

SEQ ID NO: 1402925 - protein, 9 aa, Homo Sapiens
VEELISALR

SEQ ID NO: 1402926 - protein, 9 aa, Homo Sapiens
TKWVHVRCA

SEQ ID NO: 1402927 - protein, 9 aa, Homo Sapiens
ESRERNAKR

SEQ ID NO: 1402928 - protein, 9 aa, Homo Sapiens
EKATEFYKE

SEQ ID NO: 1402929 - protein, 9 aa, Homo Sapiens
CLRGHPSAF

SEQ ID NO: 1402930 - protein, 9 aa, Homo Sapiens
FETGTKNLR

SEQ ID NO: 1402931 - protein, 9 aa, Homo Sapiens
KWEQKKFMG

SEQ ID NO: 1402932 - protein, 9 aa, Homo Sapiens
LQRCASLEP

SEQ ID NO: 1402933 - protein, 9 aa, Homo Sapiens
PPHLPGSDP

SEQ ID NO: 1402934 - protein, 9 aa, Homo Sapiens
PQGPCPPPV

SEQ ID NO: 1402935 - protein, 9 aa, Homo Sapiens
RHEYPLNLY

SEQ ID NO: 1402936 - protein, 9 aa, Homo Sapiens
AFIRHRKVY

SEQ ID NO: 1402937 - protein, 9 aa, Homo Sapiens
LHVTWSMQE

SEQ ID NO: 1402938 - protein, 9 aa, Homo Sapiens
YDPLALSGL

SEQ ID NO: 1402939 - protein, 9 aa, Homo Sapiens
HANSGPSPE

SEQ ID NO: 1402940 - protein, 9 aa, Homo Sapiens
QFVRLSWRP

SEQ ID NO: 1402941 - protein, 9 aa, Homo Sapiens
RPFQCIVCG

SEQ ID NO: 1402942 - protein, 9 aa, Homo Sapiens
TGPSTRRAD

SEQ ID NO: 1402943 - protein, 9 aa, Homo Sapiens
IYFFPFFFI

SEQ ID NO: 1402944 - protein, 9 aa, Homo Sapiens
ARCFGYLTN

SEQ ID NO: 1402945 - protein, 9 aa, Homo Sapiens
PIISPNLTF

SEQ ID NO: 1402946 - protein, 9 aa, Homo Sapiens
TSPGLLKPK

SEQ ID NO: 1402947 - protein, 9 aa, Homo Sapiens
SAKPSATSQ

SEQ ID NO: 1402948 - protein, 9 aa, Homo Sapiens
EQEKQLLGR

SEQ ID NO: 1402949 - protein, 9 aa, Homo Sapiens
IGGIATNVH

SEQ ID NO: 1402950 - protein, 9 aa, Homo Sapiens
SGMLPLEIA

SEQ ID NO: 1402951 - protein, 9 aa, Homo Sapiens
KNCIYPLSM

SEQ ID NO: 1402952 - protein, 9 aa, Homo Sapiens
WHKHSSLQP

SEQ ID NO: 1402953 - protein, 9 aa, Homo Sapiens
QRNHYFRNK

SEQ ID NO: 1402954 - protein, 9 aa, Homo Sapiens
VAHACATVG

SEQ ID NO: 1402955 - protein, 9 aa, Homo Sapiens
PQAPLRLWS

SEQ ID NO: 1402956 - protein, 9 aa, Homo Sapiens
SSMAASGKG

SEQ ID NO: 1402957 - protein, 9 aa, Homo Sapiens
PSKAWRASH

SEQ ID NO: 1402958 - protein, 9 aa, Homo Sapiens
GEKRSKALK

SEQ ID NO: 1402959 - protein, 9 aa, Homo Sapiens
YWCRSNRCR

SEQ ID NO: 1402960 - protein, 9 aa, Homo Sapiens
LTEHKVMHS

SEQ ID NO: 1402961 - protein, 9 aa, Homo Sapiens
KHSSLQPRP

SEQ ID NO: 1402962 - protein, 9 aa, Homo Sapiens
LRNFHRDLF

SEQ ID NO: 1402963 - protein, 9 aa, Homo Sapiens
IIRAKFVGT

SEQ ID NO: 1402964 - protein, 9 aa, Homo Sapiens
DNHEHQEAD

SEQ ID NO: 1402965 - protein, 9 aa, Homo Sapiens
YNMDFLTLR

SEQ ID NO: 1402966 - protein, 9 aa, Homo Sapiens
HLLYTESKK

SEQ ID NO: 1402967 - protein, 9 aa, Homo Sapiens
MFWLIKPQW

SEQ ID NO: 1402968 - protein, 9 aa, Homo Sapiens
YRGRTSILQ

SEQ ID NO: 1402969 - protein, 9 aa, Homo Sapiens
CPSKKSTRP

SEQ ID NO: 1402970 - protein, 9 aa, Homo Sapiens
LYHALPFFL

SEQ ID NO: 1402971 - protein, 9 aa, Homo Sapiens
LPTNQPLGK

SEQ ID NO: 1402972 - protein, 9 aa, Homo Sapiens
EQPPHLPGS

SEQ ID NO: 1402973 - protein, 9 aa, Homo Sapiens
MIAMCLAQL

SEQ ID NO: 1402974 - protein, 9 aa, Homo Sapiens
KTQATTSTE

SEQ ID NO: 1402975 - protein, 9 aa, Homo Sapiens
NISEGLVMY

SEQ ID NO: 1402976 - protein, 9 aa, Homo Sapiens
VLFKADQSE

SEQ ID NO: 1402977 - protein, 9 aa, Homo Sapiens
CMVRAATLI

SEQ ID NO: 1402978 - protein, 9 aa, Homo Sapiens
SQFVRLSWR

SEQ ID NO: 1402979 - protein, 9 aa, Homo Sapiens
PSAFNNLKN

SEQ ID NO: 1402980 - protein, 9 aa, Homo Sapiens
MHMQISNAE

SEQ ID NO: 1402981 - protein, 9 aa, Homo Sapiens
WDAPCPLLE

SEQ ID NO: 1402982 - protein, 9 aa, Homo Sapiens
DDKNTYIHY

SEQ ID NO: 1402983 - protein, 9 aa, Homo Sapiens
LTKQLLALG

SEQ ID NO: 1402984 - protein, 9 aa, Homo Sapiens
FFHPSGRLE

SEQ ID NO: 1402985 - protein, 9 aa, Homo Sapiens
CASLEPKNK

SEQ ID NO: 1402986 - protein, 9 aa, Homo Sapiens
SHHQGFGLT

SEQ ID NO: 1402987 - protein, 9 aa, Homo Sapiens
GTQQVLLDN

SEQ ID NO: 1402988 - protein, 9 aa, Homo Sapiens
SWFLSVHTR

SEQ ID NO: 1402989 - protein, 9 aa, Homo Sapiens
TQELAEMPP

SEQ ID NO: 1402990 - protein, 9 aa, Homo Sapiens
EMTGLGKQV

SEQ ID NO: 1402991 - protein, 9 aa, Homo Sapiens
CFGYLTNQL

SEQ ID NO: 1402992 - protein, 9 aa, Homo Sapiens
KLAVKPKKT

SEQ ID NO: 1402993 - protein, 9 aa, Homo Sapiens
VFCQLCSWF

SEQ ID NO: 1402994 - protein, 9 aa, Homo Sapiens
PLGGPSLWA

SEQ ID NO: 1402995 - protein, 9 aa, Homo Sapiens
HQEADAHHD

SEQ ID NO: 1402996 - protein, 9 aa, Homo Sapiens
NQLMGLAGG

SEQ ID NO: 1402997 - protein, 9 aa, Homo Sapiens
LPKKKKVWS

SEQ ID NO: 1402998 - protein, 9 aa, Homo Sapiens
QAVNKSGTQ

SEQ ID NO: 1402999 - protein, 9 aa, Homo Sapiens
KKKVRSLHT

SEQ ID NO: 1403000 - protein, 9 aa, Homo Sapiens
ICRAGASAS

SEQ ID NO: 1403001 - protein, 9 aa, Homo Sapiens
SRDGWGGLW

SEQ ID NO: 1403002 - protein, 9 aa, Homo Sapiens
LCHALQDLD

SEQ ID NO: 1403003 - protein, 9 aa, Homo Sapiens
IRKRNYVWD

SEQ ID NO: 1403004 - protein, 9 aa, Homo Sapiens
RPEQLPQHA

SEQ ID NO: 1403005 - protein, 9 aa, Homo Sapiens
AASWATPQR

SEQ ID NO: 1403006 - protein, 9 aa, Homo Sapiens
RHGCHMVIA

SEQ ID NO: 1403007 - protein, 9 aa, Homo Sapiens
DGPTVPPGP

SEQ ID NO: 1403008 - protein, 9 aa, Homo Sapiens
GLWLMSPNR

SEQ ID NO: 1403009 - protein, 9 aa, Homo Sapiens
PAALLLRSS

SEQ ID NO: 1403010 - protein, 9 aa, Homo Sapiens
LNGTQQVLL

SEQ ID NO: 1403011 - protein, 9 aa, Homo Sapiens
GRTSILQDG

SEQ ID NO: 1403012 - protein, 9 aa, Homo Sapiens
SKHGLFWAN

SEQ ID NO: 1403013 - protein, 9 aa, Homo Sapiens
SPQNIGAGR

SEQ ID NO: 1403014 - protein, 9 aa, Homo Sapiens
LLLTLPLLQ

SEQ ID NO: 1403015 - protein, 9 aa, Homo Sapiens
TQQVLLDNV

SEQ ID NO: 1403016 - protein, 9 aa, Homo Sapiens
WCKMPHPPP

SEQ ID NO: 1403017 - protein, 9 aa, Homo Sapiens
IEHVQSLVC

SEQ ID NO: 1403018 - protein, 9 aa, Homo Sapiens
EQKKFMGTE

SEQ ID NO: 1403019 - protein, 9 aa, Homo Sapiens
FRQFHADFT

SEQ ID NO: 1403020 - protein, 9 aa, Homo Sapiens
AGTAGARHH

SEQ ID NO: 1403021 - protein, 9 aa, Homo Sapiens
YCSLSFPGS

SEQ ID NO: 1403022 - protein, 9 aa, Homo Sapiens
LGGSHVVVC

SEQ ID NO: 1403023 - protein, 9 aa, Homo Sapiens
YLGWASHRD

SEQ ID NO: 1403024 - protein, 9 aa, Homo Sapiens
SRRPRFIRC

SEQ ID NO: 1403025 - protein, 9 aa, Homo Sapiens
EGNGTKNSC

SEQ ID NO: 1403026 - protein, 9 aa, Homo Sapiens
KSSLRVATE

SEQ ID NO: 1403027 - protein, 9 aa, Homo Sapiens
LDHFGNMAN

SEQ ID NO: 1403028 - protein, 9 aa, Homo Sapiens
TGRGRAAAR

SEQ ID NO: 1403029 - protein, 9 aa, Homo Sapiens
ETDIRAKKW

SEQ ID NO: 1403030 - protein, 9 aa, Homo Sapiens
FYLMEPVWH

SEQ ID NO: 1403031 - protein, 9 aa, Homo Sapiens
RTMEDPGVR

SEQ ID NO: 1403032 - protein, 9 aa, Homo Sapiens
EESDNKKET

SEQ ID NO: 1403033 - protein, 9 aa, Homo Sapiens
PFNDPFFMV

SEQ ID NO: 1403034 - protein, 9 aa, Homo Sapiens
EDERLCANL

SEQ ID NO: 1403035 - protein, 9 aa, Homo Sapiens
STVHVVNAT

SEQ ID NO: 1403036 - protein, 9 aa, Homo Sapiens
VGVSGDLAP

SEQ ID NO: 1403037 - protein, 9 aa, Homo Sapiens
RSPQQLKET

SEQ ID NO: 1403038 - protein, 9 aa, Homo Sapiens
KDQDGKITW

SEQ ID NO: 1403039 - protein, 9 aa, Homo Sapiens
ERDYNMDFL

SEQ ID NO: 1403040 - protein, 9 aa, Homo Sapiens
TGKFALNAV

SEQ ID NO: 1403041 - protein, 9 aa, Homo Sapiens
DRPHISSKV

SEQ ID NO: 1403042 - protein, 9 aa, Homo Sapiens
DEKRVAQRA

SEQ ID NO: 1403043 - protein, 9 aa, Homo Sapiens
ILQDGITAG

SEQ ID NO: 1403044 - protein, 9 aa, Homo Sapiens
FHRWGHWMD

SEQ ID NO: 1403045 - protein, 9 aa, Homo Sapiens
AVLLPASWF

SEQ ID NO: 1403046 - protein, 9 aa, Homo Sapiens
NSPKKLRRT

SEQ ID NO: 1403047 - protein, 9 aa, Homo Sapiens
CDDHFQGYL

SEQ ID NO: 1403048 - protein, 9 aa, Homo Sapiens
IVFELTCQI

SEQ ID NO: 1403049 - protein, 9 aa, Homo Sapiens
QDVEPNHFR

SEQ ID NO: 1403050 - protein, 9 aa, Homo Sapiens
TAISQHASG

SEQ ID NO: 1403051 - protein, 9 aa, Homo Sapiens
ASTLVWKFF

SEQ ID NO: 1403052 - protein, 9 aa, Homo Sapiens
LPSCKKKSS

SEQ ID NO: 1403053 - protein, 9 aa, Homo Sapiens
KRSKALKST

SEQ ID NO: 1403054 - protein, 9 aa, Homo Sapiens
LASVTLYKE

SEQ ID NO: 1403055 - protein, 9 aa, Homo Sapiens
EGNFGAVGA

SEQ ID NO: 1403056 - protein, 9 aa, Homo Sapiens
VVAGLDREK

SEQ ID NO: 1403057 - protein, 9 aa, Homo Sapiens
WMKIYFQSR

SEQ ID NO: 1403058 - protein, 9 aa, Homo Sapiens
PSCLKQDPP

SEQ ID NO: 1403059 - protein, 9 aa, Homo Sapiens
QEILRDSTN

SEQ ID NO: 1403060 - protein, 9 aa, Homo Sapiens
RTIGKNSPK

SEQ ID NO: 1403061 - protein, 9 aa, Homo Sapiens
DAVGEPRWA

SEQ ID NO: 1403062 - protein, 9 aa, Homo Sapiens
HGPKYWRRS

SEQ ID NO: 1403063 - protein, 9 aa, Homo Sapiens
PGACFAQAH

SEQ ID NO: 1403064 - protein, 9 aa, Homo Sapiens
ILPAALPKK

SEQ ID NO: 1403065 - protein, 9 aa, Homo Sapiens
ATTSTEASS

SEQ ID NO: 1403066 - protein, 9 aa, Homo Sapiens
VLEQHTKAV

SEQ ID NO: 1403067 - protein, 9 aa, Homo Sapiens
HITQHQIIP

SEQ ID NO: 1403068 - protein, 9 aa, Homo Sapiens
CYLDSPDFH

SEQ ID NO: 1403069 - protein, 9 aa, Homo Sapiens
HHSQLMFAA

SEQ ID NO: 1403070 - protein, 9 aa, Homo Sapiens
TWQEFIDGI

SEQ ID NO: 1403071 - protein, 9 aa, Homo Sapiens
ADQSESSLS

SEQ ID NO: 1403072 - protein, 9 aa, Homo Sapiens
SGVLMLVAL

SEQ ID NO: 1403073 - protein, 9 aa, Homo Sapiens
TLKPPTPCS

SEQ ID NO: 1403074 - protein, 9 aa, Homo Sapiens
FIVSMRYFL

SEQ ID NO: 1403075 - protein, 9 aa, Homo Sapiens
RARTRWTTA

SEQ ID NO: 1403076 - protein, 9 aa, Homo Sapiens
DIRKRNYVW

SEQ ID NO: 1403077 - protein, 9 aa, Homo Sapiens
EKMFPWMVT

SEQ ID NO: 1403078 - protein, 9 aa, Homo Sapiens
YFQSRLVCG

SEQ ID NO: 1403079 - protein, 9 aa, Homo Sapiens
HAAPSAQRA

SEQ ID NO: 1403080 - protein, 9 aa, Homo Sapiens
KFALNAVDN

SEQ ID NO: 1403081 - protein, 9 aa, Homo Sapiens
TLALVGGEI

SEQ ID NO: 1403082 - protein, 9 aa, Homo Sapiens
GEAEWHKLL

SEQ ID NO: 1403083 - protein, 9 aa, Homo Sapiens
AQQAMAMVD

SEQ ID NO: 1403084 - protein, 9 aa, Homo Sapiens
STVCRESER

SEQ ID NO: 1403085 - protein, 9 aa, Homo Sapiens
IMVRIAPEE

SEQ ID NO: 1403086 - protein, 9 aa, Homo Sapiens
EAETLALVG

SEQ ID NO: 1403087 - protein, 9 aa, Homo Sapiens
SEQLNGTQQ

SEQ ID NO: 1403088 - protein, 9 aa, Homo Sapiens
RLHVTWSMQ

SEQ ID NO: 1403089 - protein, 9 aa, Homo Sapiens
THQEAATKP

SEQ ID NO: 1403090 - protein, 9 aa, Homo Sapiens
VLKSSEISQ

SEQ ID NO: 1403091 - protein, 9 aa, Homo Sapiens
QQEERLQQL

SEQ ID NO: 1403092 - protein, 9 aa, Homo Sapiens
PAGTGKTKT

SEQ ID NO: 1403093 - protein, 9 aa, Homo Sapiens
PSTKSCGAL

SEQ ID NO: 1403094 - protein, 9 aa, Homo Sapiens
ETLLDEKRV

SEQ ID NO: 1403095 - protein, 9 aa, Homo Sapiens
KLEPEPCLW

SEQ ID NO: 1403096 - protein, 9 aa, Homo Sapiens
AFKVMNELW

SEQ ID NO: 1403097 - protein, 9 aa, Homo Sapiens
PLSISRPTS

SEQ ID NO: 1403098 - protein, 9 aa, Homo Sapiens
QQAPLQSVP

SEQ ID NO: 1403099 - protein, 9 aa, Homo Sapiens
TLNAGGQQE

SEQ ID NO: 1403100 - protein, 9 aa, Homo Sapiens
CNICQICFN

SEQ ID NO: 1403101 - protein, 9 aa, Homo Sapiens
QRHPQGPCP

SEQ ID NO: 1403102 - protein, 9 aa, Homo Sapiens
YSIPPAFRD

SEQ ID NO: 1403103 - protein, 9 aa, Homo Sapiens
VPEKGTVGV

SEQ ID NO: 1403104 - protein, 9 aa, Homo Sapiens
EFNVCGKAF

SEQ ID NO: 1403105 - protein, 9 aa, Homo Sapiens
SRTPPRRVC

SEQ ID NO: 1403106 - protein, 9 aa, Homo Sapiens
FFVLVNLEV

SEQ ID NO: 1403107 - protein, 9 aa, Homo Sapiens
VAMLPKLLC

SEQ ID NO: 1403108 - protein, 9 aa, Homo Sapiens
DSSIICLSA

SEQ ID NO: 1403109 - protein, 9 aa, Homo Sapiens
ALLGASAPC

SEQ ID NO: 1403110 - protein, 9 aa, Homo Sapiens
LMMTLKKPL

SEQ ID NO: 1403111 - protein, 9 aa, Homo Sapiens
KIFATCYLL

SEQ ID NO: 1403112 - protein, 9 aa, Homo Sapiens
FAYMLTARS

SEQ ID NO: 1403113 - protein, 9 aa, Homo Sapiens
AMAMVDIVK

SEQ ID NO: 1403114 - protein, 9 aa, Homo Sapiens
GHGASLQVV

SEQ ID NO: 1403115 - protein, 9 aa, Homo Sapiens
LDDGRVDQP

SEQ ID NO: 1403116 - protein, 9 aa, Homo Sapiens
LIFVVRFLS

SEQ ID NO: 1403117 - protein, 9 aa, Homo Sapiens
LEALKQMSL

SEQ ID NO: 1403118 - protein, 9 aa, Homo Sapiens
KTWCRCDSS

SEQ ID NO: 1403119 - protein, 9 aa, Homo Sapiens
LSGLVNQER

SEQ ID NO: 1403120 - protein, 9 aa, Homo Sapiens
GNHEEKILN

SEQ ID NO: 1403121 - protein, 9 aa, Homo Sapiens
FMGLSSLWE

SEQ ID NO: 1403122 - protein, 9 aa, Homo Sapiens
LLEGSAEMT

SEQ ID NO: 1403123 - protein, 9 aa, Homo Sapiens
LQFNLLGCL

SEQ ID NO: 1403124 - protein, 9 aa, Homo Sapiens
ATEFYKEAL

SEQ ID NO: 1403125 - protein, 9 aa, Homo Sapiens
KWVLRKALE

SEQ ID NO: 1403126 - protein, 9 aa, Homo Sapiens
VCHHITGEC

SEQ ID NO: 1403127 - protein, 9 aa, Homo Sapiens
PPPVLFKAD

SEQ ID NO: 1403128 - protein, 9 aa, Homo Sapiens
LQPRPPGLK

SEQ ID NO: 1403129 - protein, 9 aa, Homo Sapiens
SSGSTETTT

SEQ ID NO: 1403130 - protein, 9 aa, Homo Sapiens
SPVKGLWVL

SEQ ID NO: 1403131 - protein, 9 aa, Homo Sapiens
SEGLVMYPK

SEQ ID NO: 1403132 - protein, 9 aa, Homo Sapiens
RILGRVSAP

SEQ ID NO: 1403133 - protein, 9 aa, Homo Sapiens
VEQARRKQQ

SEQ ID NO: 1403134 - protein, 9 aa, Homo Sapiens
LSGSNPPIF

SEQ ID NO: 1403135 - protein, 9 aa, Homo Sapiens
SHRGCKAKT

SEQ ID NO: 1403136 - protein, 9 aa, Homo Sapiens
FAALSTPSS

SEQ ID NO: 1403137 - protein, 9 aa, Homo Sapiens
SKQRGKMRP

SEQ ID NO: 1403138 - protein, 9 aa, Homo Sapiens
KKKVWSFMT

SEQ ID NO: 1403139 - protein, 9 aa, Homo Sapiens
KKVRSLHTR

SEQ ID NO: 1403140 - protein, 9 aa, Homo Sapiens
LRSSMYRGL

SEQ ID NO: 1403141 - protein, 9 aa, Homo Sapiens
SSNSNREVA

SEQ ID NO: 1403142 - protein, 9 aa, Homo Sapiens
EAKPIGFAM

SEQ ID NO: 1403143 - protein, 9 aa, Homo Sapiens
VLLPASWFL

SEQ ID NO: 1403144 - protein, 9 aa, Homo Sapiens
HPAGVFHIG

SEQ ID NO: 1403145 - protein, 9 aa, Homo Sapiens
AEINRHCAG

SEQ ID NO: 1403146 - protein, 9 aa, Homo Sapiens
SGLFEAARV

SEQ ID NO: 1403147 - protein, 9 aa, Homo Sapiens
DGERQNQEY

SEQ ID NO: 1403148 - protein, 9 aa, Homo Sapiens
VAIYNHLLY

SEQ ID NO: 1403149 - protein, 9 aa, Homo Sapiens
LQELVDPQP

SEQ ID NO: 1403150 - protein, 9 aa, Homo Sapiens
HVERLELFP

SEQ ID NO: 1403151 - protein, 9 aa, Homo Sapiens
QTEGGRRHG

SEQ ID NO: 1403152 - protein, 9 aa, Homo Sapiens
HGLFWANIR

SEQ ID NO: 1403153 - protein, 9 aa, Homo Sapiens
KHHWLILES

SEQ ID NO: 1403154 - protein, 9 aa, Homo Sapiens
HHSHQPPAS

SEQ ID NO: 1403155 - protein, 9 aa, Homo Sapiens
QTEKEDNSN

SEQ ID NO: 1403156 - protein, 9 aa, Homo Sapiens
LKSSEISQG

SEQ ID NO: 1403157 - protein, 9 aa, Homo Sapiens
DGEDGPTVP

SEQ ID NO: 1403158 - protein, 9 aa, Homo Sapiens
GILVLRDVA

SEQ ID NO: 1403159 - protein, 9 aa, Homo Sapiens
IASSVSPPQ

SEQ ID NO: 1403160 - protein, 9 aa, Homo Sapiens
RNTRILGRV

SEQ ID NO: 1403161 - protein, 9 aa, Homo Sapiens
SLSEEQENT

SEQ ID NO: 1403162 - protein, 9 aa, Homo Sapiens
CTAQNPISQ

SEQ ID NO: 1403163 - protein, 9 aa, Homo Sapiens
TQQKSNTVE

SEQ ID NO: 1403164 - protein, 9 aa, Homo Sapiens
REVALQACL

SEQ ID NO: 1403165 - protein, 9 aa, Homo Sapiens
VHGFARSMP

SEQ ID NO: 1403166 - protein, 9 aa, Homo Sapiens
TTTLPGSTT

SEQ ID NO: 1403167 - protein, 9 aa, Homo Sapiens
TIQCQSSFN

SEQ ID NO: 1403168 - protein, 9 aa, Homo Sapiens
QVTAIGATV

SEQ ID NO: 1403169 - protein, 9 aa, Homo Sapiens
MGNFLAKGL

SEQ ID NO: 1403170 - protein, 9 aa, Homo Sapiens
LEIPLLFTA

SEQ ID NO: 1403171 - protein, 9 aa, Homo Sapiens
YTESKKARS

SEQ ID NO: 1403172 - protein, 9 aa, Homo Sapiens
IGKLALLGA

SEQ ID NO: 1403173 - protein, 9 aa, Homo Sapiens
LPPAPAPWL

SEQ ID NO: 1403174 - protein, 9 aa, Homo Sapiens
VKPKKTEGV

SEQ ID NO: 1403175 - protein, 9 aa, Homo Sapiens
NSGPSPEYT

SEQ ID NO: 1403176 - protein, 9 aa, Homo Sapiens
STRPSGSFL

SEQ ID NO: 1403177 - protein, 9 aa, Homo Sapiens
ASAEGHKKA

SEQ ID NO: 1403178 - protein, 9 aa, Homo Sapiens
AMFLDQPQQ

SEQ ID NO: 1403179 - protein, 9 aa, Homo Sapiens
MLERGEAEW

SEQ ID NO: 1403180 - protein, 9 aa, Homo Sapiens
HLCNEHFTP

SEQ ID NO: 1403181 - protein, 9 aa, Homo Sapiens
PEASHDTVT

SEQ ID NO: 1403182 - protein, 9 aa, Homo Sapiens
NTYLPDSCC

SEQ ID NO: 1403183 - protein, 9 aa, Homo Sapiens
PTPTGRGRA

SEQ ID NO: 1403184 - protein, 9 aa, Homo Sapiens
SIVHKYMQK

SEQ ID NO: 1403185 - protein, 9 aa, Homo Sapiens
FAMYTTCII

SEQ ID NO: 1403186 - protein, 9 aa, Homo Sapiens
SKTQATTST

SEQ ID NO: 1403187 - protein, 9 aa, Homo Sapiens
LQSVPPSQI

SEQ ID NO: 1403188 - protein, 9 aa, Homo Sapiens
QKPPPSSPK

SEQ ID NO: 1403189 - protein, 9 aa, Homo Sapiens
EWDNRRETF

SEQ ID NO: 1403190 - protein, 9 aa, Homo Sapiens
GEKPYEFNV

SEQ ID NO: 1403191 - protein, 9 aa, Homo Sapiens
AWAMFLDQP

SEQ ID NO: 1403192 - protein, 9 aa, Homo Sapiens
IFMGLSSLW

SEQ ID NO: 1403193 - protein, 9 aa, Homo Sapiens
KMPHPPPKP

SEQ ID NO: 1403194 - protein, 9 aa, Homo Sapiens
GHEAETLAL

SEQ ID NO: 1403195 - protein, 9 aa, Homo Sapiens
HLYFCDDHF

SEQ ID NO: 1403196 - protein, 9 aa, Homo Sapiens
AFLVALTIF

SEQ ID NO: 1403197 - protein, 9 aa, Homo Sapiens
EKYLLAMVI

SEQ ID NO: 1403198 - protein, 9 aa, Homo Sapiens
FELTCQIAH

SEQ ID NO: 1403199 - protein, 9 aa, Homo Sapiens
HVYFFQAES

SEQ ID NO: 1403200 - protein, 9 aa, Homo Sapiens
HVQLSRFAH

SEQ ID NO: 1403201 - protein, 9 aa, Homo Sapiens
TTENSRTQQ

SEQ ID NO: 1403202 - protein, 9 aa, Homo Sapiens
GDLQHALAQ

SEQ ID NO: 1403203 - protein, 9 aa, Homo Sapiens
SPHVTLAPL

SEQ ID NO: 1403204 - protein, 9 aa, Homo Sapiens
KHGLFWANI

SEQ ID NO: 1403205 - protein, 9 aa, Homo Sapiens
FLNPVACKG

SEQ ID NO: 1403206 - protein, 9 aa, Homo Sapiens
CDKVFERSS

SEQ ID NO: 1403207 - protein, 9 aa, Homo Sapiens
SLPSAPALR

SEQ ID NO: 1403208 - protein, 9 aa, Homo Sapiens
RWCSGWATS

SEQ ID NO: 1403209 - protein, 9 aa, Homo Sapiens
REHHSCTPV

SEQ ID NO: 1403210 - protein, 9 aa, Homo Sapiens
NKQVEGHVQ

SEQ ID NO: 1403211 - protein, 9 aa, Homo Sapiens
PNMPFIVSM

SEQ ID NO: 1403212 - protein, 9 aa, Homo Sapiens
DPEDERLCA

SEQ ID NO: 1403213 - protein, 9 aa, Homo Sapiens
LTNCTFVTY

SEQ ID NO: 1403214 - protein, 9 aa, Homo Sapiens
DKVFERSSA

SEQ ID NO: 1403215 - protein, 9 aa, Homo Sapiens
INMGNSLIE

SEQ ID NO: 1403216 - protein, 9 aa, Homo Sapiens
LLLGVPQTA

SEQ ID NO: 1403217 - protein, 9 aa, Homo Sapiens
EDSLWTEAL

SEQ ID NO: 1403218 - protein, 9 aa, Homo Sapiens
ATSQYYFRI

SEQ ID NO: 1403219 - protein, 9 aa, Homo Sapiens
LRHLMWMNM

SEQ ID NO: 1403220 - protein, 9 aa, Homo Sapiens
VVTLENYTH

SEQ ID NO: 1403221 - protein, 9 aa, Homo Sapiens
SAFHTLLIR

SEQ ID NO: 1403222 - protein, 9 aa, Homo Sapiens
SNHTEFVIT

SEQ ID NO: 1403223 - protein, 9 aa, Homo Sapiens
NRHCAGREP

SEQ ID NO: 1403224 - protein, 9 aa, Homo Sapiens
DSRLADHFG

SEQ ID NO: 1403225 - protein, 9 aa, Homo Sapiens
QGQTGNSKY

SEQ ID NO: 1403226 - protein, 9 aa, Homo Sapiens
FSTVCRESE

SEQ ID NO: 1403227 - protein, 9 aa, Homo Sapiens
ICFGRHYDH

SEQ ID NO: 1403228 - protein, 9 aa, Homo Sapiens
IKELYEWDN

SEQ ID NO: 1403229 - protein, 9 aa, Homo Sapiens
IFATCYLLC

SEQ ID NO: 1403230 - protein, 9 aa, Homo Sapiens
QSTKLAMSF

SEQ ID NO: 1403231 - protein, 9 aa, Homo Sapiens
TAEYEDGSS

SEQ ID NO: 1403232 - protein, 9 aa, Homo Sapiens
VKNLFKWAR

SEQ ID NO: 1403233 - protein, 9 aa, Homo Sapiens
GNPDVPPPV

SEQ ID NO: 1403234 - protein, 9 aa, Homo Sapiens
HDHNCRSAG

SEQ ID NO: 1403235 - protein, 9 aa, Homo Sapiens
WRELFVLGT

SEQ ID NO: 1403236 - protein, 9 aa, Homo Sapiens
VRASTAPTL

SEQ ID NO: 1403237 - protein, 9 aa, Homo Sapiens
RLLGSLEEL

SEQ ID NO: 1403238 - protein, 9 aa, Homo Sapiens
SLRVATELN

SEQ ID NO: 1403239 - protein, 9 aa, Homo Sapiens
KIHHSHALV

SEQ ID NO: 1403240 - protein, 9 aa, Homo Sapiens
DLDVGDCPK

SEQ ID NO: 1403241 - protein, 9 aa, Homo Sapiens
ERNMLERGE

SEQ ID NO: 1403242 - protein, 9 aa, Homo Sapiens
TPLRVQSVL

SEQ ID NO: 1403243 - protein, 9 aa, Homo Sapiens
HGHEAETLA

SEQ ID NO: 1403244 - protein, 9 aa, Homo Sapiens
EEPVSSWPE

SEQ ID NO: 1403245 - protein, 9 aa, Homo Sapiens
KDGCYWCRS

SEQ ID NO: 1403246 - protein, 9 aa, Homo Sapiens
LNEHVELLQ

SEQ ID NO: 1403247 - protein, 9 aa, Homo Sapiens
NELIMDQYA

SEQ ID NO: 1403248 - protein, 9 aa, Homo Sapiens
CKMPHPPPK

SEQ ID NO: 1403249 - protein, 9 aa, Homo Sapiens
CLKQDPPVI

SEQ ID NO: 1403250 - protein, 9 aa, Homo Sapiens
PPPVTPLRV

SEQ ID NO: 1403251 - protein, 9 aa, Homo Sapiens
LTEQLKLLH

SEQ ID NO: 1403252 - protein, 9 aa, Homo Sapiens
VSCSHLISK

SEQ ID NO: 1403253 - protein, 9 aa, Homo Sapiens
HFDPNTYLP

SEQ ID NO: 1403254 - protein, 9 aa, Homo Sapiens
AHPLRLQPP

SEQ ID NO: 1403255 - protein, 9 aa, Homo Sapiens
NVHSPHLAM

SEQ ID NO: 1403256 - protein, 9 aa, Homo Sapiens
GKGRRSSLL

SEQ ID NO: 1403257 - protein, 9 aa, Homo Sapiens
RMDGNYNLL

SEQ ID NO: 1403258 - protein, 9 aa, Homo Sapiens
KQRGKMRPK

SEQ ID NO: 1403259 - protein, 9 aa, Homo Sapiens
VVDWDVYHG

SEQ ID NO: 1403260 - protein, 9 aa, Homo Sapiens
GQVVMLHIN

SEQ ID NO: 1403261 - protein, 9 aa, Homo Sapiens
GHISESPST

SEQ ID NO: 1403262 - protein, 9 aa, Homo Sapiens
WESLEIPLL

SEQ ID NO: 1403263 - protein, 9 aa, Homo Sapiens
TPCSRWCSG

SEQ ID NO: 1403264 - protein, 9 aa, Homo Sapiens
KPKKTEGVK

SEQ ID NO: 1403265 - protein, 9 aa, Homo Sapiens
EVGVSGSST

SEQ ID NO: 1403266 - protein, 9 aa, Homo Sapiens
QQKSNTVED

SEQ ID NO: 1403267 - protein, 9 aa, Homo Sapiens
QNEFVMCRR

SEQ ID NO: 1403268 - protein, 9 aa, Homo Sapiens
CPPGTTASS

SEQ ID NO: 1403269 - protein, 9 aa, Homo Sapiens
VSIAIEHVQ

SEQ ID NO: 1403270 - protein, 9 aa, Homo Sapiens
QLLGRSWKL

SEQ ID NO: 1403271 - protein, 9 aa, Homo Sapiens
FEAARVLSP

SEQ ID NO: 1403272 - protein, 9 aa, Homo Sapiens
VVVGADGVG

SEQ ID NO: 1403273 - protein, 9 aa, Homo Sapiens
GRSPQQLKE

SEQ ID NO: 1403274 - protein, 9 aa, Homo Sapiens
KTEGVKEAQ

SEQ ID NO: 1403275 - protein, 9 aa, Homo Sapiens
AIHDSLTNC

SEQ ID NO: 1403276 - protein, 9 aa, Homo Sapiens
VTNHLLYPR

SEQ ID NO: 1403277 - protein, 9 aa, Homo Sapiens
GDDCERVGV

SEQ ID NO: 1403278 - protein, 9 aa, Homo Sapiens
HSHQPPAST

SEQ ID NO: 1403279 - protein, 9 aa, Homo Sapiens
KKLRRTPAL

SEQ ID NO: 1403280 - protein, 9 aa, Homo Sapiens
EKNLRDMHM

SEQ ID NO: 1403281 - protein, 9 aa, Homo Sapiens
ILAYCSLSF

SEQ ID NO: 1403282 - protein, 9 aa, Homo Sapiens
PTVPPGPPG

SEQ ID NO: 1403283 - protein, 9 aa, Homo Sapiens
LLALGAVDP

SEQ ID NO: 1403284 - protein, 9 aa, Homo Sapiens
HALAQAIAV

SEQ ID NO: 1403285 - protein, 9 aa, Homo Sapiens
LAFESHHQG

SEQ ID NO: 1403286 - protein, 9 aa, Homo Sapiens
QQEEELTAE

SEQ ID NO: 1403287 - protein, 9 aa, Homo Sapiens
PQNGQNPQV

SEQ ID NO: 1403288 - protein, 9 aa, Homo Sapiens
TKTVKDLGK

SEQ ID NO: 1403289 - protein, 9 aa, Homo Sapiens
CTARFIVVF

SEQ ID NO: 1403290 - protein, 9 aa, Homo Sapiens
QGRVVPVHL

SEQ ID NO: 1403291 - protein, 9 aa, Homo Sapiens
DILTLLGLG

SEQ ID NO: 1403292 - protein, 9 aa, Homo Sapiens
STRPQDGNK

SEQ ID NO: 1403293 - protein, 9 aa, Homo Sapiens
PLLLEEPSH

SEQ ID NO: 1403294 - protein, 9 aa, Homo Sapiens
EKQLLGRSW

SEQ ID NO: 1403295 - protein, 9 aa, Homo Sapiens
KGVSLVKVK

SEQ ID NO: 1403296 - protein, 9 aa, Homo Sapiens
PQTLEQEKQ

SEQ ID NO: 1403297 - protein, 9 aa, Homo Sapiens
LINVVTNHL

SEQ ID NO: 1403298 - protein, 9 aa, Homo Sapiens
TSPSLASCA

SEQ ID NO: 1403299 - protein, 9 aa, Homo Sapiens
NAKRMESIL

SEQ ID NO: 1403300 - protein, 9 aa, Homo Sapiens
WRAGFQWGE

SEQ ID NO: 1403301 - protein, 9 aa, Homo Sapiens
GSPHVTLAP

SEQ ID NO: 1403302 - protein, 9 aa, Homo Sapiens
APAPWLPMR

SEQ ID NO: 1403303 - protein, 9 aa, Homo Sapiens
LDMALRQEK

SEQ ID NO: 1403304 - protein, 9 aa, Homo Sapiens
QICFNSQSQ

SEQ ID NO: 1403305 - protein, 9 aa, Homo Sapiens
PAARATWSK

SEQ ID NO: 1403306 - protein, 9 aa, Homo Sapiens
GLARLCQSL

SEQ ID NO: 1403307 - protein, 9 aa, Homo Sapiens
HLAMAALGL

SEQ ID NO: 1403308 - protein, 9 aa, Homo Sapiens
LPTLSTLQQ

SEQ ID NO: 1403309 - protein, 9 aa, Homo Sapiens
DSPDFHERL

SEQ ID NO: 1403310 - protein, 9 aa, Homo Sapiens
HYDHNHQEL

SEQ ID NO: 1403311 - protein, 9 aa, Homo Sapiens
LPVGPPAPP

SEQ ID NO: 1403312 - protein, 9 aa, Homo Sapiens
THPAHQPLG

SEQ ID NO: 1403313 - protein, 9 aa, Homo Sapiens
IGPVGRQNH

SEQ ID NO: 1403314 - protein, 9 aa, Homo Sapiens
IPTYNRTSG

SEQ ID NO: 1403315 - protein, 9 aa, Homo Sapiens
REQFLVASL

SEQ ID NO: 1403316 - protein, 9 aa, Homo Sapiens
VCGSFARGA

SEQ ID NO: 1403317 - protein, 9 aa, Homo Sapiens
AIYNHLLYS

SEQ ID NO: 1403318 - protein, 9 aa, Homo Sapiens
LPMRSLGEP

SEQ ID NO: 1403319 - protein, 9 aa, Homo Sapiens
QTVTQPFQG

SEQ ID NO: 1403320 - protein, 9 aa, Homo Sapiens
VPVACPDDQ

SEQ ID NO: 1403321 - protein, 9 aa, Homo Sapiens
WLILESICA

SEQ ID NO: 1403322 - protein, 9 aa, Homo Sapiens
GEFPVLFLD

SEQ ID NO: 1403323 - protein, 9 aa, Homo Sapiens
LPNPRKSVV

SEQ ID NO: 1403324 - protein, 9 aa, Homo Sapiens
CNSDLIIRA

SEQ ID NO: 1403325 - protein, 9 aa, Homo Sapiens
EGSAEMTGL

SEQ ID NO: 1403326 - protein, 9 aa, Homo Sapiens
NIMSELKMV

SEQ ID NO: 1403327 - protein, 9 aa, Homo Sapiens
LRKSDLEVN

SEQ ID NO: 1403328 - protein, 9 aa, Homo Sapiens
AVGCCHTFG

SEQ ID NO: 1403329 - protein, 9 aa, Homo Sapiens
LLCRQMLPT

SEQ ID NO: 1403330 - protein, 9 aa, Homo Sapiens
DLPTECSLA

SEQ ID NO: 1403331 - protein, 9 aa, Homo Sapiens
MMTLKKPLI

SEQ ID NO: 1403332 - protein, 9 aa, Homo Sapiens
KPLPTNQPL

SEQ ID NO: 1403333 - protein, 9 aa, Homo Sapiens
EKLTEQLKL

SEQ ID NO: 1403334 - protein, 9 aa, Homo Sapiens
TPDIHSSGL

SEQ ID NO: 1403335 - protein, 9 aa, Homo Sapiens
DYLTLNAGG

SEQ ID NO: 1403336 - protein, 9 aa, Homo Sapiens
RLFAVLKQL

SEQ ID NO: 1403337 - protein, 9 aa, Homo Sapiens
ICPPGMAQR

SEQ ID NO: 1403338 - protein, 9 aa, Homo Sapiens
VLLDQFSAF

SEQ ID NO: 1403339 - protein, 9 aa, Homo Sapiens
SQLMFAALS

SEQ ID NO: 1403340 - protein, 9 aa, Homo Sapiens
TSRARQSCC

SEQ ID NO: 1403341 - protein, 9 aa, Homo Sapiens
EVNVEALIQ

SEQ ID NO: 1403342 - protein, 9 aa, Homo Sapiens
TAFCNSDLI

SEQ ID NO: 1403343 - protein, 9 aa, Homo Sapiens
HSNDCCPSS

SEQ ID NO: 1403344 - protein, 9 aa, Homo Sapiens
SRFAHPQEI

SEQ ID NO: 1403345 - protein, 9 aa, Homo Sapiens
QVVPAALLL

SEQ ID NO: 1403346 - protein, 9 aa, Homo Sapiens
HHVLKMMFW

SEQ ID NO: 1403347 - protein, 9 aa, Homo Sapiens
PELDALLCH

SEQ ID NO: 1403348 - protein, 9 aa, Homo Sapiens
PAPAPWLPM

SEQ ID NO: 1403349 - protein, 9 aa, Homo Sapiens
QSLQAVNKS

SEQ ID NO: 1403350 - protein, 9 aa, Homo Sapiens
VPCLRHIIT

SEQ ID NO: 1403351 - protein, 9 aa, Homo Sapiens
YFFPFFFIL

SEQ ID NO: 1403352 - protein, 9 aa, Homo Sapiens
EQQYRALHK

SEQ ID NO: 1403353 - protein, 9 aa, Homo Sapiens
DQSETQELA

SEQ ID NO: 1403354 - protein, 9 aa, Homo Sapiens
RIGGSTDTS

SEQ ID NO: 1403355 - protein, 9 aa, Homo Sapiens
QPPLLLEEP

SEQ ID NO: 1403356 - protein, 9 aa, Homo Sapiens
PLLAVSAAL

SEQ ID NO: 1403357 - protein, 9 aa, Homo Sapiens
GSHVVVCDI

SEQ ID NO: 1403358 - protein, 9 aa, Homo Sapiens
LLRSSMYRG

SEQ ID NO: 1403359 - protein, 9 aa, Homo Sapiens
MHSKSLDTG

SEQ ID NO: 1403360 - protein, 9 aa, Homo Sapiens
NMDTGENPE

SEQ ID NO: 1403361 - protein, 9 aa, Homo Sapiens
IKIQIEMEK

SEQ ID NO: 1403362 - protein, 9 aa, Homo Sapiens
CMLKSGWHR

SEQ ID NO: 1403363 - protein, 9 aa, Homo Sapiens
GMSRTPPRR

SEQ ID NO: 1403364 - protein, 9 aa, Homo Sapiens
YVYHGSQWM

SEQ ID NO: 1403365 - protein, 9 aa, Homo Sapiens
EGGRWKEKS

SEQ ID NO: 1403366 - protein, 9 aa, Homo Sapiens
LPGTPKLMG

SEQ ID NO: 1403367 - protein, 9 aa, Homo Sapiens
ESRLVGLTD

SEQ ID NO: 1403368 - protein, 9 aa, Homo Sapiens
SFGQVVMLH

SEQ ID NO: 1403369 - protein, 9 aa, Homo Sapiens
ELFVLGTAQ

SEQ ID NO: 1403370 - protein, 9 aa, Homo Sapiens
LKDTTTKRY

SEQ ID NO: 1403371 - protein, 9 aa, Homo Sapiens
LGTAQWAIP

SEQ ID NO: 1403372 - protein, 9 aa, Homo Sapiens
LEPEPCLWV

SEQ ID NO: 1403373 - protein, 9 aa, Homo Sapiens
PQWKQSTKL

SEQ ID NO: 1403374 - protein, 9 aa, Homo Sapiens
GHGRLVIVG

SEQ ID NO: 1403375 - protein, 9 aa, Homo Sapiens
FSFFFCLRG

SEQ ID NO: 1403376 - protein, 9 aa, Homo Sapiens
VGDCPKRPE

SEQ ID NO: 1403377 - protein, 9 aa, Homo Sapiens
ISEAEKKAQ

SEQ ID NO: 1403378 - protein, 9 aa, Homo Sapiens
DCPKRPEQL

SEQ ID NO: 1403379 - protein, 9 aa, Homo Sapiens
SKWITHLDR

SEQ ID NO: 1403380 - protein, 9 aa, Homo Sapiens
YSLICMYTL

SEQ ID NO: 1403381 - protein, 9 aa, Homo Sapiens
KPPPSSPKE

SEQ ID NO: 1403382 - protein, 9 aa, Homo Sapiens
QGPCPPPVT

SEQ ID NO: 1403383 - protein, 9 aa, Homo Sapiens
RKKKVRSLH

SEQ ID NO: 1403384 - protein, 9 aa, Homo Sapiens
TNHLLYPRH

SEQ ID NO: 1403385 - protein, 9 aa, Homo Sapiens
LGRHCFEAR

SEQ ID NO: 1403386 - protein, 9 aa, Homo Sapiens
LHPAGVFHI

SEQ ID NO: 1403387 - protein, 9 aa, Homo Sapiens
ENYHIPSIA

SEQ ID NO: 1403388 - protein, 9 aa, Homo Sapiens
DRYVAIYNH

SEQ ID NO: 1403389 - protein, 9 aa, Homo Sapiens
AAARWSARS

SEQ ID NO: 1403390 - protein, 9 aa, Homo Sapiens
TIGKNSPKK

SEQ ID NO: 1403391 - protein, 9 aa, Homo Sapiens
CPKRPEQLP

SEQ ID NO: 1403392 - protein, 9 aa, Homo Sapiens
TLEQEKQLL

SEQ ID NO: 1403393 - protein, 9 aa, Homo Sapiens
GTPKLMGSQ

SEQ ID NO: 1403394 - protein, 9 aa, Homo Sapiens
LSISRPTSR

SEQ ID NO: 1403395 - protein, 9 aa, Homo Sapiens
QVYFFHFLG

SEQ ID NO: 1403396 - protein, 9 aa, Homo Sapiens
KAHPLRLQP

SEQ ID NO: 1403397 - protein, 9 aa, Homo Sapiens
FPRTWLSVY

SEQ ID NO: 1403398 - protein, 9 aa, Homo Sapiens
SEEQENTEE

SEQ ID NO: 1403399 - protein, 9 aa, Homo Sapiens
PKKLRRTPA

SEQ ID NO: 1403400 - protein, 9 aa, Homo Sapiens
FDTLRMTKP

SEQ ID NO: 1403401 - protein, 9 aa, Homo Sapiens
KAGDWEVQR

SEQ ID NO: 1403402 - protein, 9 aa, Homo Sapiens
KKTIQCQSS

SEQ ID NO: 1403403 - protein, 9 aa, Homo Sapiens
IALTISPFS

SEQ ID NO: 1403404 - protein, 9 aa, Homo Sapiens
KYCSKVLGT

SEQ ID NO: 1403405 - protein, 9 aa, Homo Sapiens
SHHSQLMFA

SEQ ID NO: 1403406 - protein, 9 aa, Homo Sapiens
SAPCGAAGA

SEQ ID NO: 1403407 - protein, 9 aa, Homo Sapiens
TGKTKTVKD

SEQ ID NO: 1403408 - protein, 9 aa, Homo Sapiens
KNLRDMHMQ

SEQ ID NO: 1403409 - protein, 9 aa, Homo Sapiens
DYIWERFDN

SEQ ID NO: 1403410 - protein, 9 aa, Homo Sapiens
NYMIAMCLA

SEQ ID NO: 1403411 - protein, 9 aa, Homo Sapiens
YRYVYHGSQ

SEQ ID NO: 1403412 - protein, 9 aa, Homo Sapiens
IKITNEPTT

SEQ ID NO: 1403413 - protein, 9 aa, Homo Sapiens
LCQEQFLCS

SEQ ID NO: 1403414 - protein, 9 aa, Homo Sapiens
FLPPKFCRT

SEQ ID NO: 1403415 - protein, 9 aa, Homo Sapiens
VFMTSSPSY

SEQ ID NO: 1403416 - protein, 9 aa, Homo Sapiens
RYRYVYHGS

SEQ ID NO: 1403417 - protein, 9 aa, Homo Sapiens
LEQHTKAVG

SEQ ID NO: 1403418 - protein, 9 aa, Homo Sapiens
SSIMVRIAP

SEQ ID NO: 1403419 - protein, 9 aa, Homo Sapiens
ETFNEWFEH

SEQ ID NO: 1403420 - protein, 9 aa, Homo Sapiens
LLLFLRLDV

SEQ ID NO: 1403421 - protein, 9 aa, Homo Sapiens
FTSIKVVKK

SEQ ID NO: 1403422 - protein, 9 aa, Homo Sapiens
HPQTLEQEK

SEQ ID NO: 1403423 - protein, 9 aa, Homo Sapiens
NDCCPSSSK

SEQ ID NO: 1403424 - protein, 9 aa, Homo Sapiens
HIGKVVLQV

SEQ ID NO: 1403425 - protein, 9 aa, Homo Sapiens
EAQARVVRC

SEQ ID NO: 1403426 - protein, 9 aa, Homo Sapiens
EPVSSWPEE

SEQ ID NO: 1403427 - protein, 9 aa, Homo Sapiens
IGAGRPIKR

SEQ ID NO: 1403428 - protein, 9 aa, Homo Sapiens
DRVAALRWV

SEQ ID NO: 1403429 - protein, 9 aa, Homo Sapiens
EQENTEEEE

SEQ ID NO: 1403430 - protein, 9 aa, Homo Sapiens
PPGTTASSP

SEQ ID NO: 1403431 - protein, 9 aa, Homo Sapiens
ESERDYNMD

SEQ ID NO: 1403432 - protein, 9 aa, Homo Sapiens
VASTLVWKF

SEQ ID NO: 1403433 - protein, 9 aa, Homo Sapiens
VDSKTQATT

SEQ ID NO: 1403434 - protein, 9 aa, Homo Sapiens
LLSDPEDER

SEQ ID NO: 1403435 - protein, 9 aa, Homo Sapiens
PDMKQVYNF

SEQ ID NO: 1403436 - protein, 9 aa, Homo Sapiens
QFLPPKFCR

SEQ ID NO: 1403437 - protein, 9 aa, Homo Sapiens
NNVISHTGM

SEQ ID NO: 1403438 - protein, 9 aa, Homo Sapiens
KGRRSSLLW

SEQ ID NO: 1403439 - protein, 9 aa, Homo Sapiens
ATVQPQSPS

SEQ ID NO: 1403440 - protein, 9 aa, Homo Sapiens
LAMAALGLM

SEQ ID NO: 1403441 - protein, 9 aa, Homo Sapiens
VPSTYLLDT

SEQ ID NO: 1403442 - protein, 9 aa, Homo Sapiens
ITPPPHQMK

SEQ ID NO: 1403443 - protein, 9 aa, Homo Sapiens
RVGVGQVVA

SEQ ID NO: 1403444 - protein, 9 aa, Homo Sapiens
STGLFQENF

SEQ ID NO: 1403445 - protein, 9 aa, Homo Sapiens
NFNEFLFHR

SEQ ID NO: 1403446 - protein, 9 aa, Homo Sapiens
PSQVGGRLV

SEQ ID NO: 1403447 - protein, 9 aa, Homo Sapiens
LYVSCSHLI

SEQ ID NO: 1403448 - protein, 9 aa, Homo Sapiens
QSNSCPEVA

SEQ ID NO: 1403449 - protein, 9 aa, Homo Sapiens
LEQHQLQKP

SEQ ID NO: 1403450 - protein, 9 aa, Homo Sapiens
TYQDVGVTC

SEQ ID NO: 1403451 - protein, 9 aa, Homo Sapiens
PLPTPQPMP

SEQ ID NO: 1403452 - protein, 9 aa, Homo Sapiens
TRWTTAAAA

SEQ ID NO: 1403453 - protein, 9 aa, Homo Sapiens
GVLRSLAAW

SEQ ID NO: 1403454 - protein, 9 aa, Homo Sapiens
PGTTASSPE

SEQ ID NO: 1403455 - protein, 9 aa, Homo Sapiens
NEFVMCRRM

SEQ ID NO: 1403456 - protein, 9 aa, Homo Sapiens
SWCGTSQTY

SEQ ID NO: 1403457 - protein, 9 aa, Homo Sapiens
ALNTPQLAD

SEQ ID NO: 1403458 - protein, 9 aa, Homo Sapiens
KQMSLAGRE

SEQ ID NO: 1403459 - protein, 9 aa, Homo Sapiens
RLDVFILLH

SEQ ID NO: 1403460 - protein, 9 aa, Homo Sapiens
IPPILLPAL

SEQ ID NO: 1403461 - protein, 9 aa, Homo Sapiens
VPLGTSPVK

SEQ ID NO: 1403462 - protein, 9 aa, Homo Sapiens
PWRAGFQWG

SEQ ID NO: 1403463 - protein, 9 aa, Homo Sapiens
MPHPPPKPR

SEQ ID NO: 1403464 - protein, 9 aa, Homo Sapiens
PRSAVDISP

SEQ ID NO: 1403465 - protein, 9 aa, Homo Sapiens
IKIQKSQGS

SEQ ID NO: 1403466 - protein, 9 aa, Homo Sapiens
VRQFLLTFQ

SEQ ID NO: 1403467 - protein, 9 aa, Homo Sapiens
VITVYVESI

SEQ ID NO: 1403468 - protein, 9 aa, Homo Sapiens
HPCRLNKLP

SEQ ID NO: 1403469 - protein, 9 aa, Homo Sapiens
CVCAGPSWG

SEQ ID NO: 1403470 - protein, 9 aa, Homo Sapiens
ATKPLPTNQ

SEQ ID NO: 1403471 - protein, 9 aa, Homo Sapiens
NKPRSESMW

SEQ ID NO: 1403472 - protein, 9 aa, Homo Sapiens
DNDSRLADH

SEQ ID NO: 1403473 - protein, 9 aa, Homo Sapiens
IKLTLLTLA

SEQ ID NO: 1403474 - protein, 9 aa, Homo Sapiens
IICLSAEKS

SEQ ID NO: 1403475 - protein, 9 aa, Homo Sapiens
ILVLRDVAA

SEQ ID NO: 1403476 - protein, 9 aa, Homo Sapiens
SAEAGRRAN

SEQ ID NO: 1403477 - protein, 9 aa, Homo Sapiens
DPNTYLPDS

SEQ ID NO: 1403478 - protein, 9 aa, Homo Sapiens
IQKVIQNIE

SEQ ID NO: 1403479 - protein, 9 aa, Homo Sapiens
KHIHGSPFT

SEQ ID NO: 1403480 - protein, 9 aa, Homo Sapiens
IRRQTVTQP

SEQ ID NO: 1403481 - protein, 9 aa, Homo Sapiens
ATTSPGLLK

SEQ ID NO: 1403482 - protein, 9 aa, Homo Sapiens
TRPESSLTW

SEQ ID NO: 1403483 - protein, 9 aa, Homo Sapiens
QFLCSEMFF

SEQ ID NO: 1403484 - protein, 9 aa, Homo Sapiens
SQVGGRLVL

SEQ ID NO: 1403485 - protein, 9 aa, Homo Sapiens
HERLKCYEQ

SEQ ID NO: 1403486 - protein, 9 aa, Homo Sapiens
SLHITQHQI

SEQ ID NO: 1403487 - protein, 9 aa, Homo Sapiens
GNFGAVGAL

SEQ ID NO: 1403488 - protein, 9 aa, Homo Sapiens
VSLVPCLRH

SEQ ID NO: 1403489 - protein, 9 aa, Homo Sapiens
VCEQNLRPN

SEQ ID NO: 1403490 - protein, 9 aa, Homo Sapiens
PAHQPLGSM

SEQ ID NO: 1403491 - protein, 9 aa, Homo Sapiens
GGGTPLSIS

SEQ ID NO: 1403492 - protein, 9 aa, Homo Sapiens
SPVSKKAHP

SEQ ID NO: 1403493 - protein, 9 aa, Homo Sapiens
LCPLKHHSH

SEQ ID NO: 1403494 - protein, 9 aa, Homo Sapiens
EIALTISPF

SEQ ID NO: 1403495 - protein, 9 aa, Homo Sapiens
ALGAVDPQG

SEQ ID NO: 1403496 - protein, 9 aa, Homo Sapiens
HGEVQCTPQ

SEQ ID NO: 1403497 - protein, 9 aa, Homo Sapiens
KNSPKKLRR

SEQ ID NO: 1403498 - protein, 9 aa, Homo Sapiens
CYHQAASDS

SEQ ID NO: 1403499 - protein, 9 aa, Homo Sapiens
IHLHLTPTQ

SEQ ID NO: 1403500 - protein, 9 aa, Homo Sapiens
GVKAELHIL

SEQ ID NO: 1403501 - protein, 9 aa, Homo Sapiens
EHQEADAHH

SEQ ID NO: 1403502 - protein, 9 aa, Homo Sapiens
KVMNELWSK

SEQ ID NO: 1403503 - protein, 9 aa, Homo Sapiens
KQTEGGRRH

SEQ ID NO: 1403504 - protein, 9 aa, Homo Sapiens
AVQAGDGHG

SEQ ID NO: 1403505 - protein, 9 aa, Homo Sapiens
SLAKTWCRC

SEQ ID NO: 1403506 - protein, 9 aa, Homo Sapiens
LLGSLEELS

SEQ ID NO: 1403507 - protein, 9 aa, Homo Sapiens
LEREREQFL

SEQ ID NO: 1403508 - protein, 9 aa, Homo Sapiens
RYVAIYNHL

SEQ ID NO: 1403509 - protein, 9 aa, Homo Sapiens
EKAGDWEVQ

SEQ ID NO: 1403510 - protein, 9 aa, Homo Sapiens
CKSKSCLRA

SEQ ID NO: 1403511 - protein, 9 aa, Homo Sapiens
ADSLTYNIA

SEQ ID NO: 1403512 - protein, 9 aa, Homo Sapiens
EPCLWVVPG

SEQ ID NO: 1403513 - protein, 9 aa, Homo Sapiens
SMWRQCSDC

SEQ ID NO: 1403514 - protein, 9 aa, Homo Sapiens
HRGAPALSW

SEQ ID NO: 1403515 - protein, 9 aa, Homo Sapiens
MKLLLFLRL

SEQ ID NO: 1403516 - protein, 9 aa, Homo Sapiens
QQRSFWKRK

SEQ ID NO: 1403517 - protein, 9 aa, Homo Sapiens
ADVICSGPE

SEQ ID NO: 1403518 - protein, 9 aa, Homo Sapiens
VHVVNATVV

SEQ ID NO: 1403519 - protein, 9 aa, Homo Sapiens
SNTVEDPFH

SEQ ID NO: 1403520 - protein, 9 aa, Homo Sapiens
TISFRQSTH

SEQ ID NO: 1403521 - protein, 9 aa, Homo Sapiens
SIVQKLKKM

SEQ ID NO: 1403522 - protein, 9 aa, Homo Sapiens
GNMANNFTQ

SEQ ID NO: 1403523 - protein, 9 aa, Homo Sapiens
AVDYTLTQM

SEQ ID NO: 1403524 - protein, 9 aa, Homo Sapiens
EEEINKHTA

SEQ ID NO: 1403525 - protein, 9 aa, Homo Sapiens
EVKGPGRNY

SEQ ID NO: 1403526 - protein, 9 aa, Homo Sapiens
GMAQRPDGE

SEQ ID NO: 1403527 - protein, 9 aa, Homo Sapiens
GPGRNYYGN

SEQ ID NO: 1403528 - protein, 9 aa, Homo Sapiens
ETGTKNLRM

SEQ ID NO: 1403529 - protein, 9 aa, Homo Sapiens
VEEIKLTLL

SEQ ID NO: 1403530 - protein, 9 aa, Homo Sapiens
FGQVVMLHI

SEQ ID NO: 1403531 - protein, 9 aa, Homo Sapiens
WKFFLVFSE

SEQ ID NO: 1403532 - protein, 9 aa, Homo Sapiens
GTKNLRMLP

SEQ ID NO: 1403533 - protein, 9 aa, Homo Sapiens
LERGEAEWH

SEQ ID NO: 1403534 - protein, 9 aa, Homo Sapiens
KAKRYVGSI

SEQ ID NO: 1403535 - protein, 9 aa, Homo Sapiens
RWKEKSKRD

SEQ ID NO: 1403536 - protein, 9 aa, Homo Sapiens
VNVEALIQE

SEQ ID NO: 1403537 - protein, 9 aa, Homo Sapiens
KLLHERLSS

SEQ ID NO: 1403538 - protein, 9 aa, Homo Sapiens
LVVVGADGV

SEQ ID NO: 1403539 - protein, 9 aa, Homo Sapiens
KKLHPQTLE

SEQ ID NO: 1403540 - protein, 9 aa, Homo Sapiens
ATICQNNED

SEQ ID NO: 1403541 - protein, 9 aa, Homo Sapiens
QNHKVVNHS

SEQ ID NO: 1403542 - protein, 9 aa, Homo Sapiens
RGILVLRDV

SEQ ID NO: 1403543 - protein, 9 aa, Homo Sapiens
LKHHSHQPP

SEQ ID NO: 1403544 - protein, 9 aa, Homo Sapiens
QQYRALHKY

SEQ ID NO: 1403545 - protein, 9 aa, Homo Sapiens
GIQIYMLDE

SEQ ID NO: 1403546 - protein, 9 aa, Homo Sapiens
STRKSSRGT

SEQ ID NO: 1403547 - protein, 9 aa, Homo Sapiens
QGQQEEELT

SEQ ID NO: 1403548 - protein, 9 aa, Homo Sapiens
CCPSSSKCH

SEQ ID NO: 1403549 - protein, 9 aa, Homo Sapiens
GPCPPPVTP

SEQ ID NO: 1403550 - protein, 9 aa, Homo Sapiens
RTSILQDGI

SEQ ID NO: 1403551 - protein, 9 aa, Homo Sapiens
NRAKLRWIR

SEQ ID NO: 1403552 - protein, 9 aa, Homo Sapiens
PVGPPAPPQ

SEQ ID NO: 1403553 - protein, 9 aa, Homo Sapiens
CAICFGRHY

SEQ ID NO: 1403554 - protein, 9 aa, Homo Sapiens
IASAEGHKK

SEQ ID NO: 1403555 - protein, 9 aa, Homo Sapiens
PQPAFGGAE

SEQ ID NO: 1403556 - protein, 9 aa, Homo Sapiens
RVVRCRETQ

SEQ ID NO: 1403557 - protein, 9 aa, Homo Sapiens
GAEGQPPGA

SEQ ID NO: 1403558 - protein, 9 aa, Homo Sapiens
SKQTAISQH

SEQ ID NO: 1403559 - protein, 9 aa, Homo Sapiens
FYNEILKRL

SEQ ID NO: 1403560 - protein, 9 aa, Homo Sapiens
LVPRLECSG

SEQ ID NO: 1403561 - protein, 9 aa, Homo Sapiens
RTARKGEKF

SEQ ID NO: 1403562 - protein, 9 aa, Homo Sapiens
NKSPASASR

SEQ ID NO: 1403563 - protein, 9 aa, Homo Sapiens
DQPQQWLQL

SEQ ID NO: 1403564 - protein, 9 aa, Homo Sapiens
HVVNATVVT

SEQ ID NO: 1403565 - protein, 9 aa, Homo Sapiens
ALILNRHEY

SEQ ID NO: 1403566 - protein, 9 aa, Homo Sapiens
VYTGNMALA

SEQ ID NO: 1403567 - protein, 9 aa, Homo Sapiens
PALSWFPEN

SEQ ID NO: 1403568 - protein, 9 aa, Homo Sapiens
EFGQLKSGD

SEQ ID NO: 1403569 - protein, 9 aa, Homo Sapiens
ERLHLAKHE

SEQ ID NO: 1403570 - protein, 9 aa, Homo Sapiens
LGQFPNIKS

SEQ ID NO: 1403571 - protein, 9 aa, Homo Sapiens
PLRRLIIFK

SEQ ID NO: 1403572 - protein, 9 aa, Homo Sapiens
YAWAMFLDQ

SEQ ID NO: 1403573 - protein, 9 aa, Homo Sapiens
DFHERLKCY

SEQ ID NO: 1403574 - protein, 9 aa, Homo Sapiens
HKIIYTMLA

SEQ ID NO: 1403575 - protein, 9 aa, Homo Sapiens
VAGTAGARH

SEQ ID NO: 1403576 - protein, 9 aa, Homo Sapiens
LLPGTPKLM

SEQ ID NO: 1403577 - protein, 9 aa, Homo Sapiens
LTNQSPIEF

SEQ ID NO: 1403578 - protein, 9 aa, Homo Sapiens
IRKANIPNM

SEQ ID NO: 1403579 - protein, 9 aa, Homo Sapiens
HKHSSLQPR

SEQ ID NO: 1403580 - protein, 9 aa, Homo Sapiens
SDYDGIGSC

SEQ ID NO: 1403581 - protein, 9 aa, Homo Sapiens
LSGGAGHSH

SEQ ID NO: 1403582 - protein, 9 aa, Homo Sapiens
LFLLLLTAV

SEQ ID NO: 1403583 - protein, 9 aa, Homo Sapiens
VYEKMFPWM

SEQ ID NO: 1403584 - protein, 9 aa, Homo Sapiens
QGVHHVAGQ

SEQ ID NO: 1403585 - protein, 9 aa, Homo Sapiens
GGMSRTPPR

SEQ ID NO: 1403586 - protein, 9 aa, Homo Sapiens
PTEAELRGM

SEQ ID NO: 1403587 - protein, 9 aa, Homo Sapiens
HTEFVITLI

SEQ ID NO: 1403588 - protein, 9 aa, Homo Sapiens
CGMAAVPIV

SEQ ID NO: 1403589 - protein, 9 aa, Homo Sapiens
TYIHYELDY

SEQ ID NO: 1403590 - protein, 9 aa, Homo Sapiens
EEEEGSTIE

SEQ ID NO: 1403591 - protein, 9 aa, Homo Sapiens
GKVAMRYNN

SEQ ID NO: 1403592 - protein, 9 aa, Homo Sapiens
DDCERVGVG

SEQ ID NO: 1403593 - protein, 9 aa, Homo Sapiens
KIQKSQGSQ

SEQ ID NO: 1403594 - protein, 9 aa, Homo Sapiens
RHCAGREPQ

SEQ ID NO: 1403595 - protein, 9 aa, Homo Sapiens
SLGEPWRAG

SEQ ID NO: 1403596 - protein, 9 aa, Homo Sapiens
EPAVDYTLT

SEQ ID NO: 1403597 - protein, 9 aa, Homo Sapiens
IITPPPHQM

SEQ ID NO: 1403598 - protein, 9 aa, Homo Sapiens
IWSIVHKYM

SEQ ID NO: 1403599 - protein, 9 aa, Homo Sapiens
LIKPQWKQS

SEQ ID NO: 1403600 - protein, 9 aa, Homo Sapiens
VLMLVALDR

SEQ ID NO: 1403601 - protein, 9 aa, Homo Sapiens
SRVAGTAGA

SEQ ID NO: 1403602 - protein, 9 aa, Homo Sapiens
EIKLTLLTL

SEQ ID NO: 1403603 - protein, 9 aa, Homo Sapiens
SRGILVLRD

SEQ ID NO: 1403604 - protein, 9 aa, Homo Sapiens
WLPMRSLGE

SEQ ID NO: 1403605 - protein, 9 aa, Homo Sapiens
SWRCFSFSG

SEQ ID NO: 1403606 - protein, 9 aa, Homo Sapiens
ISPNLTFMG

SEQ ID NO: 1403607 - protein, 9 aa, Homo Sapiens
RSPQAPLRL

SEQ ID NO: 1403608 - protein, 9 aa, Homo Sapiens
DPMLPSHDQ

SEQ ID NO: 1403609 - protein, 9 aa, Homo Sapiens
ITWQEFIDG

SEQ ID NO: 1403610 - protein, 9 aa, Homo Sapiens
ALHKYYENC

SEQ ID NO: 1403611 - protein, 9 aa, Homo Sapiens
QIDKEATIC

SEQ ID NO: 1403612 - protein, 9 aa, Homo Sapiens
YMIAMCLAQ

SEQ ID NO: 1403613 - protein, 9 aa, Homo Sapiens
TSAASWATP

SEQ ID NO: 1403614 - protein, 9 aa, Homo Sapiens
QAMTAIQSH

SEQ ID NO: 1403615 - protein, 9 aa, Homo Sapiens
GRVVPVHLV

SEQ ID NO: 1403616 - protein, 9 aa, Homo Sapiens
PSHDQLRKK

SEQ ID NO: 1403617 - protein, 9 aa, Homo Sapiens
AGRPIKRSL

SEQ ID NO: 1403618 - protein, 9 aa, Homo Sapiens
KLHPQTLEQ

SEQ ID NO: 1403619 - protein, 9 aa, Homo Sapiens
SRERNAKRM

SEQ ID NO: 1403620 - protein, 9 aa, Homo Sapiens
IFHSGMLPL

SEQ ID NO: 1403621 - protein, 9 aa, Homo Sapiens
LKDNNYLPC

SEQ ID NO: 1403622 - protein, 9 aa, Homo Sapiens
TSQYYFRIA

SEQ ID NO: 1403623 - protein, 9 aa, Homo Sapiens
ENEESDNKK

SEQ ID NO: 1403624 - protein, 9 aa, Homo Sapiens
SAEGHKKAF

SEQ ID NO: 1403625 - protein, 9 aa, Homo Sapiens
MRYNNQINR

SEQ ID NO: 1403626 - protein, 9 aa, Homo Sapiens
HVAGQAGNE

SEQ ID NO: 1403627 - protein, 9 aa, Homo Sapiens
LTAVLVLIG

SEQ ID NO: 1403628 - protein, 9 aa, Homo Sapiens
RPLGGPSLW

SEQ ID NO: 1403629 - protein, 9 aa, Homo Sapiens
IELDCWDSP

SEQ ID NO: 1403630 - protein, 9 aa, Homo Sapiens
VPAALLLRS

SEQ ID NO: 1403631 - protein, 9 aa, Homo Sapiens
GHGHEAETL

SEQ ID NO: 1403632 - protein, 9 aa, Homo Sapiens
ADVNCACAS

SEQ ID NO: 1403633 - protein, 9 aa, Homo Sapiens
GAAQLNVFI

SEQ ID NO: 1403634 - protein, 9 aa, Homo Sapiens
RRSTEGLAR

SEQ ID NO: 1403635 - protein, 9 aa, Homo Sapiens
SCCLPGLTH

SEQ ID NO: 1403636 - protein, 9 aa, Homo Sapiens
GEPWRAGFQ

SEQ ID NO: 1403637 - protein, 9 aa, Homo Sapiens
EGRLLGSLE

SEQ ID NO: 1403638 - protein, 9 aa, Homo Sapiens
SKHIKENDY

SEQ ID NO: 1403639 - protein, 9 aa, Homo Sapiens
FSFSGHPTM

SEQ ID NO: 1403640 - protein, 9 aa, Homo Sapiens
FGYLTNQLM

SEQ ID NO: 1403641 - protein, 9 aa, Homo Sapiens
PDVPPPVLF

SEQ ID NO: 1403642 - protein, 9 aa, Homo Sapiens
LTSLPGPNQ

SEQ ID NO: 1403643 - protein, 9 aa, Homo Sapiens
NEHVELLQR

SEQ ID NO: 1403644 - protein, 9 aa, Homo Sapiens
CLCTALSSY

SEQ ID NO: 1403645 - protein, 9 aa, Homo Sapiens
NFLFLSNCH

SEQ ID NO: 1403646 - protein, 9 aa, Homo Sapiens
DEVVAPVHE

SEQ ID NO: 1403647 - protein, 9 aa, Homo Sapiens
SPKKLRRTP

SEQ ID NO: 1403648 - protein, 9 aa, Homo Sapiens
PSCKKKSSC

SEQ ID NO: 1403649 - protein, 9 aa, Homo Sapiens
VHGVINMGN

SEQ ID NO: 1403650 - protein, 9 aa, Homo Sapiens
TTSPGLLKP

SEQ ID NO: 1403651 - protein, 9 aa, Homo Sapiens
HGFARSMPT

SEQ ID NO: 1403652 - protein, 9 aa, Homo Sapiens
CRQEFGGVA

SEQ ID NO: 1403653 - protein, 9 aa, Homo Sapiens
TLASRVAGT

SEQ ID NO: 1403654 - protein, 9 aa, Homo Sapiens
TVSGASIWT

SEQ ID NO: 1403655 - protein, 9 aa, Homo Sapiens
HYGHQAPQV

SEQ ID NO: 1403656 - protein, 9 aa, Homo Sapiens
NMALAAIAV

SEQ ID NO: 1403657 - protein, 9 aa, Homo Sapiens
LNPVACKGK

SEQ ID NO: 1403658 - protein, 9 aa, Homo Sapiens
LNGGTPDIH

SEQ ID NO: 1403659 - protein, 9 aa, Homo Sapiens
WMNMNIMSE

SEQ ID NO: 1403660 - protein, 9 aa, Homo Sapiens
FFLRMDGNY

SEQ ID NO: 1403661 - protein, 9 aa, Homo Sapiens
GLGKQVLAG

SEQ ID NO: 1403662 - protein, 9 aa, Homo Sapiens
EVALQACLN

SEQ ID NO: 1403663 - protein, 9 aa, Homo Sapiens
DFGHMETVN

SEQ ID NO: 1403664 - protein, 9 aa, Homo Sapiens
LTLPLLQQT

SEQ ID NO: 1403665 - protein, 9 aa, Homo Sapiens
QSQEPSQFE

SEQ ID NO: 1403666 - protein, 9 aa, Homo Sapiens
ISALRRSWR

SEQ ID NO: 1403667 - protein, 9 aa, Homo Sapiens
NLKNCIYPL

SEQ ID NO: 1403668 - protein, 9 aa, Homo Sapiens
LYTESKKAR

SEQ ID NO: 1403669 - protein, 9 aa, Homo Sapiens
STGPSTRRA

SEQ ID NO: 1403670 - protein, 9 aa, Homo Sapiens
PHSCPYMAF

SEQ ID NO: 1403671 - protein, 9 aa, Homo Sapiens
PSLWALPVS

SEQ ID NO: 1403672 - protein, 9 aa, Homo Sapiens
QCIVCGKAF

SEQ ID NO: 1403673 - protein, 9 aa, Homo Sapiens
ASSVSPPQA

SEQ ID NO: 1403674 - protein, 9 aa, Homo Sapiens
LKAKRYVGS

SEQ ID NO: 1403675 - protein, 9 aa, Homo Sapiens
KHHSHQPPA

SEQ ID NO: 1403676 - protein, 9 aa, Homo Sapiens
LAVSAALWP

SEQ ID NO: 1403677 - protein, 9 aa, Homo Sapiens
KKPLIESKL

SEQ ID NO: 1403678 - protein, 9 aa, Homo Sapiens
DIVSLVPCL

SEQ ID NO: 1403679 - protein, 9 aa, Homo Sapiens
CVLCTISFR

SEQ ID NO: 1403680 - protein, 9 aa, Homo Sapiens
QELVDPQPP

SEQ ID NO: 1403681 - protein, 9 aa, Homo Sapiens
KRFPTTESG

SEQ ID NO: 1403682 - protein, 9 aa, Homo Sapiens
QRGKMRPKI

SEQ ID NO: 1403683 - protein, 9 aa, Homo Sapiens
VKVKQPPLL

SEQ ID NO: 1403684 - protein, 9 aa, Homo Sapiens
FGASRVDVM

SEQ ID NO: 1403685 - protein, 9 aa, Homo Sapiens
DSENESTHN

SEQ ID NO: 1403686 - protein, 9 aa, Homo Sapiens
PGVLIPHGP

SEQ ID NO: 1403687 - protein, 9 aa, Homo Sapiens
AFFFSGWIS

SEQ ID NO: 1403688 - protein, 9 aa, Homo Sapiens
GHMETVNLL

SEQ ID NO: 1403689 - protein, 9 aa, Homo Sapiens
LPLLQQTAA

SEQ ID NO: 1403690 - protein, 9 aa, Homo Sapiens
HCCICGAIV

SEQ ID NO: 1403691 - protein, 9 aa, Homo Sapiens
SCGTTTACS

SEQ ID NO: 1403692 - protein, 9 aa, Homo Sapiens
WCSGWATST

SEQ ID NO: 1403693 - protein, 9 aa, Homo Sapiens
LTRPESSLT

SEQ ID NO: 1403694 - protein, 9 aa, Homo Sapiens
GRRQAKKLH

SEQ ID NO: 1403695 - protein, 9 aa, Homo Sapiens
RSRRPRFIR

SEQ ID NO: 1403696 - protein, 9 aa, Homo Sapiens
LSRFAHPQE

SEQ ID NO: 1403697 - protein, 9 aa, Homo Sapiens
FAQVTSTLL

SEQ ID NO: 1403698 - protein, 9 aa, Homo Sapiens
NQSPIEFPD

SEQ ID NO: 1403699 - protein, 9 aa, Homo Sapiens
LFLDLMTIC

SEQ ID NO: 1403700 - protein, 9 aa, Homo Sapiens
AGCMLKSGW

SEQ ID NO: 1403701 - protein, 9 aa, Homo Sapiens
PAVDYTLTQ

SEQ ID NO: 1403702 - protein, 9 aa, Homo Sapiens
AAPTPTGRG

SEQ ID NO: 1403703 - protein, 9 aa, Homo Sapiens
YFQQTGVHG

SEQ ID NO: 1403704 - protein, 9 aa, Homo Sapiens
QTGNSKYSC

SEQ ID NO: 1403705 - protein, 9 aa, Homo Sapiens
MLPSHDQLR

SEQ ID NO: 1403706 - protein, 9 aa, Homo Sapiens
KHTAAENDF

SEQ ID NO: 1403707 - protein, 9 aa, Homo Sapiens
QSETQELAE

SEQ ID NO: 1403708 - protein, 9 aa, Homo Sapiens
TGNSKYSCK

SEQ ID NO: 1403709 - protein, 9 aa, Homo Sapiens
RSSSALSCA

SEQ ID NO: 1403710 - protein, 9 aa, Homo Sapiens
GMMSEIDRD

SEQ ID NO: 1403711 - protein, 9 aa, Homo Sapiens
FLGPIIFSL

SEQ ID NO: 1403712 - protein, 9 aa, Homo Sapiens
FNEFLFHRW

SEQ ID NO: 1403713 - protein, 9 aa, Homo Sapiens
QEMVCMVRA

SEQ ID NO: 1403714 - protein, 9 aa, Homo Sapiens
LKQEGGNNE

SEQ ID NO: 1403715 - protein, 9 aa, Homo Sapiens
RTQQSNSCP

SEQ ID NO: 1403716 - protein, 9 aa, Homo Sapiens
YCSKVLGTD

SEQ ID NO: 1403717 - protein, 9 aa, Homo Sapiens
FKQLAYLWM

SEQ ID NO: 1403718 - protein, 9 aa, Homo Sapiens
NQPLGKNQD

SEQ ID NO: 1403719 - protein, 9 aa, Homo Sapiens
NHEHQEADA

SEQ ID NO: 1403720 - protein, 9 aa, Homo Sapiens
GLETIGVKI

SEQ ID NO: 1403721 - protein, 9 aa, Homo Sapiens
KEIIAPLDE

SEQ ID NO: 1403722 - protein, 9 aa, Homo Sapiens
GQGVHHVAG

SEQ ID NO: 1403723 - protein, 9 aa, Homo Sapiens
TYLGQFPNI

SEQ ID NO: 1403724 - protein, 9 aa, Homo Sapiens
PTNQPLGKN

SEQ ID NO: 1403725 - protein, 9 aa, Homo Sapiens
LLPALKIFA

SEQ ID NO: 1403726 - protein, 9 aa, Homo Sapiens
VFELTCQIA

SEQ ID NO: 1403727 - protein, 9 aa, Homo Sapiens
FFFLHKEFL

SEQ ID NO: 1403728 - protein, 9 aa, Homo Sapiens
PPDLAPNVT

SEQ ID NO: 1403729 - protein, 9 aa, Homo Sapiens
ASRVAGTAG

SEQ ID NO: 1403730 - protein, 9 aa, Homo Sapiens
LQKPPPSSP

SEQ ID NO: 1403731 - protein, 9 aa, Homo Sapiens
VLDGTHCGP

SEQ ID NO: 1403732 - protein, 9 aa, Homo Sapiens
YFFFLRMDG

SEQ ID NO: 1403733 - protein, 9 aa, Homo Sapiens
HILDVKDVD

SEQ ID NO: 1403734 - protein, 9 aa, Homo Sapiens
TTESGAALF

SEQ ID NO: 1403735 - protein, 9 aa, Homo Sapiens
SGTKWVHVR

SEQ ID NO: 1403736 - protein, 9 aa, Homo Sapiens
NGDYEKATE

SEQ ID NO: 1403737 - protein, 9 aa, Homo Sapiens
LETIGVKIN

SEQ ID NO: 1403738 - protein, 9 aa, Homo Sapiens
TFNEWFEHM

SEQ ID NO: 1403739 - protein, 9 aa, Homo Sapiens
NLCLPGSRD

SEQ ID NO: 1403740 - protein, 9 aa, Homo Sapiens
VDPQPPQKF

SEQ ID NO: 1403741 - protein, 9 aa, Homo Sapiens
EMFGDEGVM

SEQ ID NO: 1403742 - protein, 9 aa, Homo Sapiens
DGDGQGRVV

SEQ ID NO: 1403743 - protein, 9 aa, Homo Sapiens
RQNHKVVNH

SEQ ID NO: 1403744 - protein, 9 aa, Homo Sapiens
GNMALAAIA

SEQ ID NO: 1403745 - protein, 9 aa, Homo Sapiens
PCGAAGARE

SEQ ID NO: 1403746 - protein, 9 aa, Homo Sapiens
IKGLTRCQA

SEQ ID NO: 1403747 - protein, 9 aa, Homo Sapiens
VLPSCKKKS

SEQ ID NO: 1403748 - protein, 9 aa, Homo Sapiens
HFDTLRMTK

SEQ ID NO: 1403749 - protein, 9 aa, Homo Sapiens
GSQNFALTK

SEQ ID NO: 1403750 - protein, 9 aa, Homo Sapiens
ASSPECGFA

SEQ ID NO: 1403751 - protein, 9 aa, Homo Sapiens
CNLCLPGSR

SEQ ID NO: 1403752 - protein, 9 aa, Homo Sapiens
NNLLCQLWM

SEQ ID NO: 1403753 - protein, 9 aa, Homo Sapiens
PSSSKCHNK

SEQ ID NO: 1403754 - protein, 9 aa, Homo Sapiens
WGPSTPSCG

SEQ ID NO: 1403755 - protein, 9 aa, Homo Sapiens
VALDRYVAI

SEQ ID NO: 1403756 - protein, 9 aa, Homo Sapiens
NFALTKHHW

SEQ ID NO: 1403757 - protein, 9 aa, Homo Sapiens
NPVACKGKA

SEQ ID NO: 1403758 - protein, 9 aa, Homo Sapiens
FAQAHFDFS

SEQ ID NO: 1403759 - protein, 9 aa, Homo Sapiens
RNKEVKGPG

SEQ ID NO: 1403760 - protein, 9 aa, Homo Sapiens
LWRKVQSLG

SEQ ID NO: 1403761 - protein, 9 aa, Homo Sapiens
PLLEGSAEM

SEQ ID NO: 1403762 - protein, 9 aa, Homo Sapiens
FVVRFLSGL

SEQ ID NO: 1403763 - protein, 9 aa, Homo Sapiens
EPVWHVWTT

SEQ ID NO: 1403764 - protein, 9 aa, Homo Sapiens
CHMVIASRS

SEQ ID NO: 1403765 - protein, 9 aa, Homo Sapiens
VYHGSQWMV

SEQ ID NO: 1403766 - protein, 9 aa, Homo Sapiens
QMLPTLSTL

SEQ ID NO: 1403767 - protein, 9 aa, Homo Sapiens
TNTLEISNI

SEQ ID NO: 1403768 - protein, 9 aa, Homo Sapiens
GLVMYPKVI

SEQ ID NO: 1403769 - protein, 9 aa, Homo Sapiens
TSNEGGRWK

SEQ ID NO: 1403770 - protein, 9 aa, Homo Sapiens
GTHQVQNAK

SEQ ID NO: 1403771 - protein, 9 aa, Homo Sapiens
SVLLLGVPQ

SEQ ID NO: 1403772 - protein, 9 aa, Homo Sapiens
AQAIAVQAG

SEQ ID NO: 1403773 - protein, 9 aa, Homo Sapiens
ASWFLSVHT

SEQ ID NO: 1403774 - protein, 9 aa, Homo Sapiens
TGSLTNQSP

SEQ ID NO: 1403775 - protein, 9 aa, Homo Sapiens
PLSGGAGHS

SEQ ID NO: 1403776 - protein, 9 aa, Homo Sapiens
KKKLEKKQD

SEQ ID NO: 1403777 - protein, 9 aa, Homo Sapiens
KQLLALGAV

SEQ ID NO: 1403778 - protein, 9 aa, Homo Sapiens
SFAIHQEDA

SEQ ID NO: 1403779 - protein, 9 aa, Homo Sapiens
CQSSFNICG

SEQ ID NO: 1403780 - protein, 9 aa, Homo Sapiens
NDTEFYWRE

SEQ ID NO: 1403781 - protein, 9 aa, Homo Sapiens
FGQLKSGDA

SEQ ID NO: 1403782 - protein, 9 aa, Homo Sapiens
DCIRLSAEN

SEQ ID NO: 1403783 - protein, 9 aa, Homo Sapiens
KDKLKKQFL

SEQ ID NO: 1403784 - protein, 9 aa, Homo Sapiens
EKYYLSIFM

SEQ ID NO: 1403785 - protein, 9 aa, Homo Sapiens
RVAHACATV

SEQ ID NO: 1403786 - protein, 9 aa, Homo Sapiens
HLDRVAALR

SEQ ID NO: 1403787 - protein, 9 aa, Homo Sapiens
MFLDQPQQW

SEQ ID NO: 1403788 - protein, 9 aa, Homo Sapiens
PWMVTRINQ

SEQ ID NO: 1403789 - protein, 9 aa, Homo Sapiens
IVSMRYFLV

SEQ ID NO: 1403790 - protein, 9 aa, Homo Sapiens
TAGARHHTR

SEQ ID NO: 1403791 - protein, 9 aa, Homo Sapiens
PFFHPSGRL

SEQ ID NO: 1403792 - protein, 9 aa, Homo Sapiens
TTEPFMTHS

SEQ ID NO: 1403793 - protein, 9 aa, Homo Sapiens
HEEKILNRE

SEQ ID NO: 1403794 - protein, 9 aa, Homo Sapiens
VLRDSLPPH

SEQ ID NO: 1403795 - protein, 9 aa, Homo Sapiens
MTKPEPAAL

SEQ ID NO: 1403796 - protein, 9 aa, Homo Sapiens
QNLEEDIGQ

SEQ ID NO: 1403797 - protein, 9 aa, Homo Sapiens
DRNTRILGR

SEQ ID NO: 1403798 - protein, 9 aa, Homo Sapiens
DVPGSKRSF

SEQ ID NO: 1403799 - protein, 9 aa, Homo Sapiens
GRVSAPEAS

SEQ ID NO: 1403800 - protein, 9 aa, Homo Sapiens
LKLWDLASV

SEQ ID NO: 1403801 - protein, 9 aa, Homo Sapiens
VGLTDEINF

SEQ ID NO: 1403802 - protein, 9 aa, Homo Sapiens
LLQPSSLTA

SEQ ID NO: 1403803 - protein, 9 aa, Homo Sapiens
DQKPKNKEN

SEQ ID NO: 1403804 - protein, 9 aa, Homo Sapiens
LSNCHNSKL

SEQ ID NO: 1403805 - protein, 9 aa, Homo Sapiens
GGTGSGMST

SEQ ID NO: 1403806 - protein, 9 aa, Homo Sapiens
VCTGYNASR

SEQ ID NO: 1403807 - protein, 9 aa, Homo Sapiens
IPNMDTGEN

SEQ ID NO: 1403808 - protein, 9 aa, Homo Sapiens
YTEEKSHEC

SEQ ID NO: 1403809 - protein, 9 aa, Homo Sapiens
EGHVQLSRF

SEQ ID NO: 1403810 - protein, 9 aa, Homo Sapiens
QGSPHVTLA

SEQ ID NO: 1403811 - protein, 9 aa, Homo Sapiens
WGHLDRVAA

SEQ ID NO: 1403812 - protein, 9 aa, Homo Sapiens
NHSNDCCPS

SEQ ID NO: 1403813 - protein, 9 aa, Homo Sapiens
CCLPGLTHP

SEQ ID NO: 1403814 - protein, 9 aa, Homo Sapiens
GRFAVLGTM

SEQ ID NO: 1403815 - protein, 9 aa, Homo Sapiens
WASHRDVPG

SEQ ID NO: 1403816 - protein, 9 aa, Homo Sapiens
LLLRSSMYR

SEQ ID NO: 1403817 - protein, 9 aa, Homo Sapiens
KIASAEGHK

SEQ ID NO: 1403818 - protein, 9 aa, Homo Sapiens
DEFLMGGMS

SEQ ID NO: 1403819 - protein, 9 aa, Homo Sapiens
QPKTNKTMG

SEQ ID NO: 1403820 - protein, 9 aa, Homo Sapiens
NIANNKDAL

SEQ ID NO: 1403821 - protein, 9 aa, Homo Sapiens
LICRAGASA

SEQ ID NO: 1403822 - protein, 9 aa, Homo Sapiens
TGKAPSPRV

SEQ ID NO: 1403823 - protein, 9 aa, Homo Sapiens
PLRLWSWCG

SEQ ID NO: 1403824 - protein, 9 aa, Homo Sapiens
TNFRFQPQV

SEQ ID NO: 1403825 - protein, 9 aa, Homo Sapiens
TFEDFPQSL

SEQ ID NO: 1403826 - protein, 9 aa, Homo Sapiens
AVFYCGMAA

SEQ ID NO: 1403827 - protein, 9 aa, Homo Sapiens
CSCQNEFVM

SEQ ID NO: 1403828 - protein, 9 aa, Homo Sapiens
CSVPVCCGD

SEQ ID NO: 1403829 - protein, 9 aa, Homo Sapiens
STYLLDTEG

SEQ ID NO: 1403830 - protein, 9 aa, Homo Sapiens
ELRGMMSEI

SEQ ID NO: 1403831 - protein, 9 aa, Homo Sapiens
SERDYNMDF

SEQ ID NO: 1403832 - protein, 9 aa, Homo Sapiens
EFYWRELVS

SEQ ID NO: 1403833 - protein, 9 aa, Homo Sapiens
VPPGPPGPP

SEQ ID NO: 1403834 - protein, 9 aa, Homo Sapiens
CWCKMPHPP

SEQ ID NO: 1403835 - protein, 9 aa, Homo Sapiens
KNSCSRTRG

SEQ ID NO: 1403836 - protein, 9 aa, Homo Sapiens
PPVTPLRVQ

SEQ ID NO: 1403837 - protein, 9 aa, Homo Sapiens
PDDQGGAAQ

SEQ ID NO: 1403838 - protein, 9 aa, Homo Sapiens
PSDHQSQEP

SEQ ID NO: 1403839 - protein, 9 aa, Homo Sapiens
PSLHRYLSL

SEQ ID NO: 1403840 - protein, 9 aa, Homo Sapiens
PFKCVLCTI

SEQ ID NO: 1403841 - protein, 9 aa, Homo Sapiens
LELQINGFI

SEQ ID NO: 1403842 - protein, 9 aa, Homo Sapiens
RLSAENVPC

SEQ ID NO: 1403843 - protein, 9 aa, Homo Sapiens
PAARLVASK

SEQ ID NO: 1403844 - protein, 9 aa, Homo Sapiens
CIRLSAENV

SEQ ID NO: 1403845 - protein, 9 aa, Homo Sapiens
GSIDICHQV

SEQ ID NO: 1403846 - protein, 9 aa, Homo Sapiens
DAHGPKYWR

SEQ ID NO: 1403847 - protein, 9 aa, Homo Sapiens
RLRPLGGPS

SEQ ID NO: 1403848 - protein, 9 aa, Homo Sapiens
DKLKKQFLP

SEQ ID NO: 1403849 - protein, 9 aa, Homo Sapiens
LHNIVSIFT

SEQ ID NO: 1403850 - protein, 9 aa, Homo Sapiens
CGLTRPESS

SEQ ID NO: 1403851 - protein, 9 aa, Homo Sapiens
MKIYFQSRL

SEQ ID NO: 1403852 - protein, 9 aa, Homo Sapiens
ETVNLLSSN

SEQ ID NO: 1403853 - protein, 9 aa, Homo Sapiens
TEGVKEAQA

SEQ ID NO: 1403854 - protein, 9 aa, Homo Sapiens
WDSPDGMPV

SEQ ID NO: 1403855 - protein, 9 aa, Homo Sapiens
LKQMSLAGR

SEQ ID NO: 1403856 - protein, 9 aa, Homo Sapiens
VMYPKVIER

SEQ ID NO: 1403857 - protein, 9 aa, Homo Sapiens
YLLDTEGAF

SEQ ID NO: 1403858 - protein, 9 aa, Homo Sapiens
SVEEIKLTL

SEQ ID NO: 1403859 - protein, 9 aa, Homo Sapiens
LYLLGSNKS

SEQ ID NO: 1403860 - protein, 9 aa, Homo Sapiens
KPIGFAMYT

SEQ ID NO: 1403861 - protein, 9 aa, Homo Sapiens
ISESPSTKS

SEQ ID NO: 1403862 - protein, 9 aa, Homo Sapiens
QRSCVCAGP

SEQ ID NO: 1403863 - protein, 9 aa, Homo Sapiens
ECSLAIEIF

SEQ ID NO: 1403864 - protein, 9 aa, Homo Sapiens
NRHEYPLNL

SEQ ID NO: 1403865 - protein, 9 aa, Homo Sapiens
DQFSAFPVN

SEQ ID NO: 1403866 - protein, 9 aa, Homo Sapiens
FQCIVCGKA

SEQ ID NO: 1403867 - protein, 9 aa, Homo Sapiens
EREHHSCTP

SEQ ID NO: 1403868 - protein, 9 aa, Homo Sapiens
HTGEKPYEF

SEQ ID NO: 1403869 - protein, 9 aa, Homo Sapiens
DPLALSGLP

SEQ ID NO: 1403870 - protein, 9 aa, Homo Sapiens
ELDCWDSPD

SEQ ID NO: 1403871 - protein, 9 aa, Homo Sapiens
HLRPSWCPP

SEQ ID NO: 1403872 - protein, 9 aa, Homo Sapiens
KKQFLPPKF

SEQ ID NO: 1403873 - protein, 9 aa, Homo Sapiens
LSVYSAPGS

SEQ ID NO: 1403874 - protein, 9 aa, Homo Sapiens
RWARLPQRR

SEQ ID NO: 1403875 - protein, 9 aa, Homo Sapiens
TEFYWRELV

SEQ ID NO: 1403876 - protein, 9 aa, Homo Sapiens
LDEKRVAQR

SEQ ID NO: 1403877 - protein, 9 aa, Homo Sapiens
EKLCLTRIR

SEQ ID NO: 1403878 - protein, 9 aa, Homo Sapiens
VVTNHLLYP

SEQ ID NO: 1403879 - protein, 9 aa, Homo Sapiens
MVETLCICW

SEQ ID NO: 1403880 - protein, 9 aa, Homo Sapiens
IRVENEDPL

SEQ ID NO: 1403881 - protein, 9 aa, Homo Sapiens
PPVKPNMPF

SEQ ID NO: 1403882 - protein, 9 aa, Homo Sapiens
STLLISKIR

SEQ ID NO: 1403883 - protein, 9 aa, Homo Sapiens
LRALFLEVI

SEQ ID NO: 1403884 - protein, 9 aa, Homo Sapiens
SSSETSSIV

SEQ ID NO: 1403885 - protein, 9 aa, Homo Sapiens
YGTFLCLCH

SEQ ID NO: 1403886 - protein, 9 aa, Homo Sapiens
PLLQQTAAK

SEQ ID NO: 1403887 - protein, 9 aa, Homo Sapiens
PVNDNSSIM

SEQ ID NO: 1403888 - protein, 9 aa, Homo Sapiens
PNQILPAAL

SEQ ID NO: 1403889 - protein, 9 aa, Homo Sapiens
HETFNEWFE

SEQ ID NO: 1403890 - protein, 9 aa, Homo Sapiens
TCQIAHILP

SEQ ID NO: 1403891 - protein, 9 aa, Homo Sapiens
RVQSVLLLG

SEQ ID NO: 1403892 - protein, 9 aa, Homo Sapiens
MSLAGREKL

SEQ ID NO: 1403893 - protein, 9 aa, Homo Sapiens
CSCNHGEVQ

SEQ ID NO: 1403894 - protein, 9 aa, Homo Sapiens
GESPWQVMA

SEQ ID NO: 1403895 - protein, 9 aa, Homo Sapiens
EQEGRLLGS

SEQ ID NO: 1403896 - protein, 9 aa, Homo Sapiens
TKNLRMLPL

SEQ ID NO: 1403897 - protein, 9 aa, Homo Sapiens
KPPTPCSRW

SEQ ID NO: 1403898 - protein, 9 aa, Homo Sapiens
LPGPNQILP

SEQ ID NO: 1403899 - protein, 9 aa, Homo Sapiens
PSSTHAPAR

SEQ ID NO: 1403900 - protein, 9 aa, Homo Sapiens
FVSIAIEHV

SEQ ID NO: 1403901 - protein, 9 aa, Homo Sapiens
ISFRQSTHL

SEQ ID NO: 1403902 - protein, 9 aa, Homo Sapiens
ASNKKDIDD

SEQ ID NO: 1403903 - protein, 9 aa, Homo Sapiens
GLPGLFDCE

SEQ ID NO: 1403904 - protein, 9 aa, Homo Sapiens
HKSKKGPPV

SEQ ID NO: 1403905 - protein, 9 aa, Homo Sapiens
KDIVSLVPC

SEQ ID NO: 1403906 - protein, 9 aa, Homo Sapiens
DCLQAFWDM

SEQ ID NO: 1403907 - protein, 9 aa, Homo Sapiens
DIIRFAPQL

SEQ ID NO: 1403908 - protein, 9 aa, Homo Sapiens
IIGGTDQAQ

SEQ ID NO: 1403909 - protein, 9 aa, Homo Sapiens
FMTHSIIAS

SEQ ID NO: 1403910 - protein, 9 aa, Homo Sapiens
NCTFVTYDP

SEQ ID NO: 1403911 - protein, 9 aa, Homo Sapiens
AKYDVIDKD

SEQ ID NO: 1403912 - protein, 9 aa, Homo Sapiens
FLLFTWQVF

SEQ ID NO: 1403913 - protein, 9 aa, Homo Sapiens
EADAHHDHN

SEQ ID NO: 1403914 - protein, 9 aa, Homo Sapiens
SKVIPPILL

SEQ ID NO: 1403915 - protein, 9 aa, Homo Sapiens
TAVCDIPPQ

SEQ ID NO: 1403916 - protein, 9 aa, Homo Sapiens
LCQLWMKIY

SEQ ID NO: 1403917 - protein, 9 aa, Homo Sapiens
HGPPMCGPD

SEQ ID NO: 1403918 - protein, 9 aa, Homo Sapiens
IQKSQGSQN

SEQ ID NO: 1403919 - protein, 9 aa, Homo Sapiens
ATVVTMPVP

SEQ ID NO: 1403920 - protein, 9 aa, Homo Sapiens
LKKSSRKDG

SEQ ID NO: 1403921 - protein, 9 aa, Homo Sapiens
TKQLLALGA

SEQ ID NO: 1403922 - protein, 9 aa, Homo Sapiens
FLCLCHQGY

SEQ ID NO: 1403923 - protein, 9 aa, Homo Sapiens
FDSEKAGDW

SEQ ID NO: 1403924 - protein, 9 aa, Homo Sapiens
LPSHDQLRK

SEQ ID NO: 1403925 - protein, 9 aa, Homo Sapiens
QPQSPSHEA

SEQ ID NO: 1403926 - protein, 9 aa, Homo Sapiens
LTPTQIRKR

SEQ ID NO: 1403927 - protein, 9 aa, Homo Sapiens
RLWSWCGTS

SEQ ID NO: 1403928 - protein, 9 aa, Homo Sapiens
YDGIGSCGD

SEQ ID NO: 1403929 - protein, 9 aa, Homo Sapiens
AREAGRFAV

SEQ ID NO: 1403930 - protein, 9 aa, Homo Sapiens
FQAESKYTF

SEQ ID NO: 1403931 - protein, 9 aa, Homo Sapiens
IEPLFGASR

SEQ ID NO: 1403932 - protein, 9 aa, Homo Sapiens
FLDDGRVDQ

SEQ ID NO: 1403933 - protein, 9 aa, Homo Sapiens
LRLQPPKAL

SEQ ID NO: 1403934 - protein, 9 aa, Homo Sapiens
SVCSCQNEF

SEQ ID NO: 1403935 - protein, 9 aa, Homo Sapiens
SRLADHFGG

SEQ ID NO: 1403936 - protein, 9 aa, Homo Sapiens
KTNKTMGFK

SEQ ID NO: 1403937 - protein, 9 aa, Homo Sapiens
RNSVGPSCL

SEQ ID NO: 1403938 - protein, 9 aa, Homo Sapiens
KVWSFMTHQ

SEQ ID NO: 1403939 - protein, 9 aa, Homo Sapiens
PVDSKTQAT

SEQ ID NO: 1403940 - protein, 9 aa, Homo Sapiens
VFHIGPVGR

SEQ ID NO: 1403941 - protein, 9 aa, Homo Sapiens
SLQGTTEPF

SEQ ID NO: 1403942 - protein, 9 aa, Homo Sapiens
LLPGVLIPH

SEQ ID NO: 1403943 - protein, 9 aa, Homo Sapiens
GLSSLWESL

SEQ ID NO: 1403944 - protein, 9 aa, Homo Sapiens
LNGIRTMED

SEQ ID NO: 1403945 - protein, 9 aa, Homo Sapiens
ALSLKKSSR

SEQ ID NO: 1403946 - protein, 9 aa, Homo Sapiens
ETQELAEMP

SEQ ID NO: 1403947 - protein, 9 aa, Homo Sapiens
ADRMPQFSL

SEQ ID NO: 1403948 - protein, 9 aa, Homo Sapiens
LTCQIAHIL

SEQ ID NO: 1403949 - protein, 9 aa, Homo Sapiens
QKSNTVEDP

SEQ ID NO: 1403950 - protein, 9 aa, Homo Sapiens
YLGQFPNIK

SEQ ID NO: 1403951 - protein, 9 aa, Homo Sapiens
SASFSPNFA

SEQ ID NO: 1403952 - protein, 9 aa, Homo Sapiens
NKHTAAEND

SEQ ID NO: 1403953 - protein, 9 aa, Homo Sapiens
NLYLLGSNK

SEQ ID NO: 1403954 - protein, 9 aa, Homo Sapiens
IYKDYIWER

SEQ ID NO: 1403955 - protein, 9 aa, Homo Sapiens
SESPSTKSC

SEQ ID NO: 1403956 - protein, 9 aa, Homo Sapiens
TNCTFVTYD

SEQ ID NO: 1403957 - protein, 9 aa, Homo Sapiens
QVPLGTSPV

SEQ ID NO: 1403958 - protein, 9 aa, Homo Sapiens
ADGERQNQE

SEQ ID NO: 1403959 - protein, 9 aa, Homo Sapiens
AICFGRHYD

SEQ ID NO: 1403960 - protein, 9 aa, Homo Sapiens
FLFLSNCHN

SEQ ID NO: 1403961 - protein, 9 aa, Homo Sapiens
ALNRYVAIC

SEQ ID NO: 1403962 - protein, 9 aa, Homo Sapiens
RYNNQINRN

SEQ ID NO: 1403963 - protein, 9 aa, Homo Sapiens
KSDLEVNVE

SEQ ID NO: 1403964 - protein, 9 aa, Homo Sapiens
KKPWWWHLC

SEQ ID NO: 1403965 - protein, 9 aa, Homo Sapiens
GVQRGQLPG

SEQ ID NO: 1403966 - protein, 9 aa, Homo Sapiens
ESAGPLLHL

SEQ ID NO: 1403967 - protein, 9 aa, Homo Sapiens
SAQRAEDSS

SEQ ID NO: 1403968 - protein, 9 aa, Homo Sapiens
PKYPQDNHE

SEQ ID NO: 1403969 - protein, 9 aa, Homo Sapiens
VAMRYNNQI

SEQ ID NO: 1403970 - protein, 9 aa, Homo Sapiens
DKVLHNIVS

SEQ ID NO: 1403971 - protein, 9 aa, Homo Sapiens
QVAMLPKLL

SEQ ID NO: 1403972 - protein, 9 aa, Homo Sapiens
SKVLGTDSS

SEQ ID NO: 1403973 - protein, 9 aa, Homo Sapiens
HGCHMVIAS

SEQ ID NO: 1403974 - protein, 9 aa, Homo Sapiens
EHLRPSWCP

SEQ ID NO: 1403975 - protein, 9 aa, Homo Sapiens
REAGRFAVL

SEQ ID NO: 1403976 - protein, 9 aa, Homo Sapiens
GCVPFLEIL

SEQ ID NO: 1403977 - protein, 9 aa, Homo Sapiens
EEEGSTIEA

SEQ ID NO: 1403978 - protein, 9 aa, Homo Sapiens
SKKARSQHY

SEQ ID NO: 1403979 - protein, 9 aa, Homo Sapiens
RSNRCRIGF

SEQ ID NO: 1403980 - protein, 9 aa, Homo Sapiens
LNAGGQQER

SEQ ID NO: 1403981 - protein, 9 aa, Homo Sapiens
YMLDEHLEI

SEQ ID NO: 1403982 - protein, 9 aa, Homo Sapiens
LILESICAK

SEQ ID NO: 1403983 - protein, 9 aa, Homo Sapiens
CNLYLLGSN

SEQ ID NO: 1403984 - protein, 9 aa, Homo Sapiens
VANSNPPVW

SEQ ID NO: 1403985 - protein, 9 aa, Homo Sapiens
GKMIRRQTV

SEQ ID NO: 1403986 - protein, 9 aa, Homo Sapiens
NDSRLADHF

SEQ ID NO: 1403987 - protein, 9 aa, Homo Sapiens
SLRLLCSII

SEQ ID NO: 1403988 - protein, 9 aa, Homo Sapiens
LLDTEGAFT

SEQ ID NO: 1403989 - protein, 9 aa, Homo Sapiens
ALSWFPENG

SEQ ID NO: 1403990 - protein, 9 aa, Homo Sapiens
SPQAPLRLW

SEQ ID NO: 1403991 - protein, 9 aa, Homo Sapiens
NQILPAALP

SEQ ID NO: 1403992 - protein, 9 aa, Homo Sapiens
DNNYLPCPI

SEQ ID NO: 1403993 - protein, 9 aa, Homo Sapiens
EHKVMHSKS

SEQ ID NO: 1403994 - protein, 9 aa, Homo Sapiens
PWWWHLCVQ

SEQ ID NO: 1403995 - protein, 9 aa, Homo Sapiens
ALRRVLLDQ

SEQ ID NO: 1403996 - protein, 9 aa, Homo Sapiens
ALEKSYKCT

SEQ ID NO: 1403997 - protein, 9 aa, Homo Sapiens
FGGVAPRCP

SEQ ID NO: 1403998 - protein, 9 aa, Homo Sapiens
SLKQIHLHL

SEQ ID NO: 1403999 - protein, 9 aa, Homo Sapiens
PKHPSVEEI

SEQ ID NO: 1404000 - protein, 9 aa, Homo Sapiens
ELKMVTSTG

SEQ ID NO: 1404001 - protein, 9 aa, Homo Sapiens
GSLTNQSPI

SEQ ID NO: 1404002 - protein, 9 aa, Homo Sapiens
PAVSHRGCK

SEQ ID NO: 1404003 - protein, 9 aa, Homo Sapiens
RASTAPTLS

SEQ ID NO: 1404004 - protein, 9 aa, Homo Sapiens
PAATASTRP

SEQ ID NO: 1404005 - protein, 9 aa, Homo Sapiens
FAPQLVIKE

SEQ ID NO: 1404006 - protein, 9 aa, Homo Sapiens
VSGSSTGPS

SEQ ID NO: 1404007 - protein, 9 aa, Homo Sapiens
LDVGDCPKR

SEQ ID NO: 1404008 - protein, 9 aa, Homo Sapiens
FHSGMLPLE

SEQ ID NO: 1404009 - protein, 9 aa, Homo Sapiens
SCQNEFVMC

SEQ ID NO: 1404010 - protein, 9 aa, Homo Sapiens
LALVGGEIT

SEQ ID NO: 1404011 - protein, 9 aa, Homo Sapiens
YTVLTPFLG

SEQ ID NO: 1404012 - protein, 9 aa, Homo Sapiens
LASKGNLER

SEQ ID NO: 1404013 - protein, 9 aa, Homo Sapiens
NTREGGWTN

SEQ ID NO: 1404014 - protein, 9 aa, Homo Sapiens
GASLLLQPS

SEQ ID NO: 1404015 - protein, 9 aa, Homo Sapiens
TIHVAIVCT

SEQ ID NO: 1404016 - protein, 9 aa, Homo Sapiens
TPQRSCVCA

SEQ ID NO: 1404017 - protein, 9 aa, Homo Sapiens
DTEFYWREL

SEQ ID NO: 1404018 - protein, 9 aa, Homo Sapiens
KLPNQVKWM

SEQ ID NO: 1404019 - protein, 9 aa, Homo Sapiens
SIFMGLSSL

SEQ ID NO: 1404020 - protein, 9 aa, Homo Sapiens
FIWGLAAQE

SEQ ID NO: 1404021 - protein, 9 aa, Homo Sapiens
RKEKHNADY

SEQ ID NO: 1404022 - protein, 9 aa, Homo Sapiens
PVSSWPEEA

SEQ ID NO: 1404023 - protein, 9 aa, Homo Sapiens
MAVEFDGGI

SEQ ID NO: 1404024 - protein, 9 aa, Homo Sapiens
AATASTRPQ

SEQ ID NO: 1404025 - protein, 9 aa, Homo Sapiens
YRALHKYYE

SEQ ID NO: 1404026 - protein, 9 aa, Homo Sapiens
GVAPRCPRS

SEQ ID NO: 1404027 - protein, 9 aa, Homo Sapiens
GRQNHKVVN

SEQ ID NO: 1404028 - protein, 9 aa, Homo Sapiens
TLRHLMWMN

SEQ ID NO: 1404029 - protein, 9 aa, Homo Sapiens
TPLPTPQPM

SEQ ID NO: 1404030 - protein, 9 aa, Homo Sapiens
AMTAIQSHK

SEQ ID NO: 1404031 - protein, 9 aa, Homo Sapiens
TSTAASTPS

SEQ ID NO: 1404032 - protein, 9 aa, Homo Sapiens
ENIFVSIAI

SEQ ID NO: 1404033 - protein, 9 aa, Homo Sapiens
IISPNLTFM

SEQ ID NO: 1404034 - protein, 9 aa, Homo Sapiens
QGSQNFALT

SEQ ID NO: 1404035 - protein, 9 aa, Homo Sapiens
SMYRGLWLM

SEQ ID NO: 1404036 - protein, 9 aa, Homo Sapiens
PWCLLQGLW

SEQ ID NO: 1404037 - protein, 9 aa, Homo Sapiens
FLFHRWGHW

SEQ ID NO: 1404038 - protein, 9 aa, Homo Sapiens
TPPPHQMKC

SEQ ID NO: 1404039 - protein, 9 aa, Homo Sapiens
TSDILTLLG

SEQ ID NO: 1404040 - protein, 9 aa, Homo Sapiens
WWWHLCVQE

SEQ ID NO: 1404041 - protein, 9 aa, Homo Sapiens
VWKFFLVFS

SEQ ID NO: 1404042 - protein, 9 aa, Homo Sapiens
CFGRHYDHN

SEQ ID NO: 1404043 - protein, 9 aa, Homo Sapiens
VNDNSSIMV

SEQ ID NO: 1404044 - protein, 9 aa, Homo Sapiens
PTTESGAAL

SEQ ID NO: 1404045 - protein, 9 aa, Homo Sapiens
RPCKSKSCL

SEQ ID NO: 1404046 - protein, 9 aa, Homo Sapiens
SSALSCASS

SEQ ID NO: 1404047 - protein, 9 aa, Homo Sapiens
KQVEGHVQL

SEQ ID NO: 1404048 - protein, 9 aa, Homo Sapiens
MTDMFRQFH

SEQ ID NO: 1404049 - protein, 9 aa, Homo Sapiens
WFPENGLPG

SEQ ID NO: 1404050 - protein, 9 aa, Homo Sapiens
KSGWHRVGE

SEQ ID NO: 1404051 - protein, 9 aa, Homo Sapiens
ESLSEEQEN

SEQ ID NO: 1404052 - protein, 9 aa, Homo Sapiens
PQHALVCLR

SEQ ID NO: 1404053 - protein, 9 aa, Homo Sapiens
MKQVYNFIY

SEQ ID NO: 1404054 - protein, 9 aa, Homo Sapiens
ASKGNLERL

SEQ ID NO: 1404055 - protein, 9 aa, Homo Sapiens
TSTGLFQEN

SEQ ID NO: 1404056 - protein, 9 aa, Homo Sapiens
TDISENYHI

SEQ ID NO: 1404057 - protein, 9 aa, Homo Sapiens
LGKNQDLTS

SEQ ID NO: 1404058 - protein, 9 aa, Homo Sapiens
CVVCGSFAR

SEQ ID NO: 1404059 - protein, 9 aa, Homo Sapiens
FRVVTLENY

SEQ ID NO: 1404060 - protein, 9 aa, Homo Sapiens
SAENVPCIV

SEQ ID NO: 1404061 - protein, 9 aa, Homo Sapiens
QHTKAVGCC

SEQ ID NO: 1404062 - protein, 9 aa, Homo Sapiens
LSLSGRLAW

SEQ ID NO: 1404063 - protein, 9 aa, Homo Sapiens
SEGKSDSSI

SEQ ID NO: 1404064 - protein, 9 aa, Homo Sapiens
GKITWQEFI

SEQ ID NO: 1404065 - protein, 9 aa, Homo Sapiens
KVLHNIVSI

SEQ ID NO: 1404066 - protein, 9 aa, Homo Sapiens
EDGSSIPLA

SEQ ID NO: 1404067 - protein, 9 aa, Homo Sapiens
AFIWGLAAQ

SEQ ID NO: 1404068 - protein, 9 aa, Homo Sapiens
NTVEDPFHS

SEQ ID NO: 1404069 - protein, 9 aa, Homo Sapiens
QLLALGAVD

SEQ ID NO: 1404070 - protein, 9 aa, Homo Sapiens
FCDDHFQGY

SEQ ID NO: 1404071 - protein, 9 aa, Homo Sapiens
GWFDAHGPK

SEQ ID NO: 1404072 - protein, 9 aa, Homo Sapiens
LPGLTHPAH

SEQ ID NO: 1404073 - protein, 9 aa, Homo Sapiens
CGEMFRLYR

SEQ ID NO: 1404074 - protein, 9 aa, Homo Sapiens
VNVHSPHLA

SEQ ID NO: 1404075 - protein, 9 aa, Homo Sapiens
PISQRSSLP

SEQ ID NO: 1404076 - protein, 9 aa, Homo Sapiens
AKPIGFAMY

SEQ ID NO: 1404077 - protein, 9 aa, Homo Sapiens
SNSCPEVAT

SEQ ID NO: 1404078 - protein, 9 aa, Homo Sapiens
WVVFCQLCS

SEQ ID NO: 1404079 - protein, 9 aa, Homo Sapiens
VLTPFLGPI

SEQ ID NO: 1404080 - protein, 9 aa, Homo Sapiens
NGTKNSCSR

SEQ ID NO: 1404081 - protein, 9 aa, Homo Sapiens
NESTHNGNN

SEQ ID NO: 1404082 - protein, 9 aa, Homo Sapiens
PNSREEAQQ

SEQ ID NO: 1404083 - protein, 9 aa, Homo Sapiens
KKSSRKDGC

SEQ ID NO: 1404084 - protein, 9 aa, Homo Sapiens
VMNYVEHNL

SEQ ID NO: 1404085 - protein, 9 aa, Homo Sapiens
EEIKLTLLT

SEQ ID NO: 1404086 - protein, 9 aa, Homo Sapiens
MNMNIMSEL

SEQ ID NO: 1404087 - protein, 9 aa, Homo Sapiens
HFTSIKVVK

SEQ ID NO: 1404088 - protein, 9 aa, Homo Sapiens
RTREEEEGS

SEQ ID NO: 1404089 - protein, 9 aa, Homo Sapiens
AQRAEDSSE

SEQ ID NO: 1404090 - protein, 9 aa, Homo Sapiens
FYLIHPTNA

SEQ ID NO: 1404091 - protein, 9 aa, Homo Sapiens
LDDRSPQAP

SEQ ID NO: 1404092 - protein, 9 aa, Homo Sapiens
QQQAPLQSV

SEQ ID NO: 1404093 - protein, 9 aa, Homo Sapiens
HHTREIFVL

SEQ ID NO: 1404094 - protein, 9 aa, Homo Sapiens
AEIASALGH

SEQ ID NO: 1404095 - protein, 9 aa, Homo Sapiens
SEEAIKKTW

SEQ ID NO: 1404096 - protein, 9 aa, Homo Sapiens
RRSWRYRGD

SEQ ID NO: 1404097 - protein, 9 aa, Homo Sapiens
YFRIASSVS

SEQ ID NO: 1404098 - protein, 9 aa, Homo Sapiens
CGRHSSSSN

SEQ ID NO: 1404099 - protein, 9 aa, Homo Sapiens
AARATWSKD

SEQ ID NO: 1404100 - protein, 9 aa, Homo Sapiens
NREVALQAC

SEQ ID NO: 1404101 - protein, 9 aa, Homo Sapiens
GRGRAAARW

SEQ ID NO: 1404102 - protein, 9 aa, Homo Sapiens
SIICLSAEK

SEQ ID NO: 1404103 - protein, 9 aa, Homo Sapiens
HLLYSVSMS

SEQ ID NO: 1404104 - protein, 9 aa, Homo Sapiens
AGPSWGPST

SEQ ID NO: 1404105 - protein, 9 aa, Homo Sapiens
CSGTILAYC

SEQ ID NO: 1404106 - protein, 9 aa, Homo Sapiens
VCSCQNEFV

SEQ ID NO: 1404107 - protein, 9 aa, Homo Sapiens
RSAVDISPG

SEQ ID NO: 1404108 - protein, 9 aa, Homo Sapiens
RKIGLETIG

SEQ ID NO: 1404109 - protein, 9 aa, Homo Sapiens
GHPTMWLSF

SEQ ID NO: 1404110 - protein, 9 aa, Homo Sapiens
MDGNYNLLP

SEQ ID NO: 1404111 - protein, 9 aa, Homo Sapiens
QRCASLEPK

SEQ ID NO: 1404112 - protein, 9 aa, Homo Sapiens
YMEMHYGHQ

SEQ ID NO: 1404113 - protein, 9 aa, Homo Sapiens
SLEVLIEDL

SEQ ID NO: 1404114 - protein, 9 aa, Homo Sapiens
DVNCACASH

SEQ ID NO: 1404115 - protein, 9 aa, Homo Sapiens
NKTMGFKIN

SEQ ID NO: 1404116 - protein, 9 aa, Homo Sapiens
HQVQNAKRE

SEQ ID NO: 1404117 - protein, 9 aa, Homo Sapiens
SAETTEPVK

SEQ ID NO: 1404118 - protein, 9 aa, Homo Sapiens
KPQWKQSTK

SEQ ID NO: 1404119 - protein, 9 aa, Homo Sapiens
LWSGPTSAA

SEQ ID NO: 1404120 - protein, 9 aa, Homo Sapiens
FCNSDLIIR

SEQ ID NO: 1404121 - protein, 9 aa, Homo Sapiens
TYNIANNKD

SEQ ID NO: 1404122 - protein, 9 aa, Homo Sapiens
RNFHRDLFL

SEQ ID NO: 1404123 - protein, 9 aa, Homo Sapiens
ENEHVNRLQ

SEQ ID NO: 1404124 - protein, 9 aa, Homo Sapiens
CERVGVGQV

SEQ ID NO: 1404125 - protein, 9 aa, Homo Sapiens
DNSNINPRQ

SEQ ID NO: 1404126 - protein, 9 aa, Homo Sapiens
QAPCPGSTT

SEQ ID NO: 1404127 - protein, 9 aa, Homo Sapiens
LPGLLPLCC

SEQ ID NO: 1404128 - protein, 9 aa, Homo Sapiens
IRKRPCKSK

SEQ ID NO: 1404129 - protein, 9 aa, Homo Sapiens
EMHYGHQAP

SEQ ID NO: 1404130 - protein, 9 aa, Homo Sapiens
APCGAAGAR

SEQ ID NO: 1404131 - protein, 9 aa, Homo Sapiens
QQPAATAST

SEQ ID NO: 1404132 - protein, 9 aa, Homo Sapiens
VSGASIWTW

SEQ ID NO: 1404133 - protein, 9 aa, Homo Sapiens
TASSPECGF

SEQ ID NO: 1404134 - protein, 9 aa, Homo Sapiens
LFAYMLTAR

SEQ ID NO: 1404135 - protein, 9 aa, Homo Sapiens
EEPSKQRGK

SEQ ID NO: 1404136 - protein, 9 aa, Homo Sapiens
KHVPRVVHI

SEQ ID NO: 1404137 - protein, 9 aa, Homo Sapiens
PPVWYSWRR

SEQ ID NO: 1404138 - protein, 9 aa, Homo Sapiens
VLKMMFWLI

SEQ ID NO: 1404139 - protein, 9 aa, Homo Sapiens
QRMTRLHVT

SEQ ID NO: 1404140 - protein, 9 aa, Homo Sapiens
RKSDLEVNV

SEQ ID NO: 1404141 - protein, 9 aa, Homo Sapiens
HPPPKPRYA

SEQ ID NO: 1404142 - protein, 9 aa, Homo Sapiens
EAIKKTWTS

SEQ ID NO: 1404143 - protein, 9 aa, Homo Sapiens
VTIKIALNT

SEQ ID NO: 1404144 - protein, 9 aa, Homo Sapiens
DSLWTEALW

SEQ ID NO: 1404145 - protein, 9 aa, Homo Sapiens
VLPIQFKQL

SEQ ID NO: 1404146 - protein, 9 aa, Homo Sapiens
QWKQSTKLA

SEQ ID NO: 1404147 - protein, 9 aa, Homo Sapiens
SNPPIFHSG

SEQ ID NO: 1404148 - protein, 9 aa, Homo Sapiens
SAVDISPGP

SEQ ID NO: 1404149 - protein, 9 aa, Homo Sapiens
LIPHGPPMC

SEQ ID NO: 1404150 - protein, 9 aa, Homo Sapiens
ILVAFLVAL

SEQ ID NO: 1404151 - protein, 9 aa, Homo Sapiens
ILKQEGGNN

SEQ ID NO: 1404152 - protein, 9 aa, Homo Sapiens
LQHALAQAI

SEQ ID NO: 1404153 - protein, 9 aa, Homo Sapiens
KIFYLIHPT

SEQ ID NO: 1404154 - protein, 9 aa, Homo Sapiens
GSAEMTGLG

SEQ ID NO: 1404155 - protein, 9 aa, Homo Sapiens
QAPLQSVPP

SEQ ID NO: 1404156 - protein, 9 aa, Homo Sapiens
NIFVSIAIE

SEQ ID NO: 1404157 - protein, 9 aa, Homo Sapiens
LRDMHMQIS

SEQ ID NO: 1404158 - protein, 9 aa, Homo Sapiens
ATVILLYTS

SEQ ID NO: 1404159 - protein, 9 aa, Homo Sapiens
RDGEDGPTV

SEQ ID NO: 1404160 - protein, 9 aa, Homo Sapiens
KMVTSTGLF

SEQ ID NO: 1404161 - protein, 9 aa, Homo Sapiens
AFHTLLIRV

SEQ ID NO: 1404162 - protein, 9 aa, Homo Sapiens
MFGKVAMRY

SEQ ID NO: 1404163 - protein, 9 aa, Homo Sapiens
QWGESPWQV

SEQ ID NO: 1404164 - protein, 9 aa, Homo Sapiens
NPQVVPAAL

SEQ ID NO: 1404165 - protein, 9 aa, Homo Sapiens
PFHSWRKLT

SEQ ID NO: 1404166 - protein, 9 aa, Homo Sapiens
RPTKNTREG

SEQ ID NO: 1404167 - protein, 9 aa, Homo Sapiens
ENYMIAMCL

SEQ ID NO: 1404168 - protein, 9 aa, Homo Sapiens
HLDMALRQE

SEQ ID NO: 1404169 - protein, 9 aa, Homo Sapiens
TSPVSKKAH

SEQ ID NO: 1404170 - protein, 9 aa, Homo Sapiens
LEEDIGQSE

SEQ ID NO: 1404171 - protein, 9 aa, Homo Sapiens
AHGPKYWRR

SEQ ID NO: 1404172 - protein, 9 aa, Homo Sapiens
LLHFAHMFE

SEQ ID NO: 1404173 - protein, 9 aa, Homo Sapiens
RRLAEINRH

SEQ ID NO: 1404174 - protein, 9 aa, Homo Sapiens
LFFVLVNLE

SEQ ID NO: 1404175 - protein, 9 aa, Homo Sapiens
VVPSKWITH

SEQ ID NO: 1404176 - protein, 9 aa, Homo Sapiens
KSAISKEII

SEQ ID NO: 1404177 - protein, 9 aa, Homo Sapiens
QHASGNTFS

SEQ ID NO: 1404178 - protein, 9 aa, Homo Sapiens
SGASIWTWS

SEQ ID NO: 1404179 - protein, 9 aa, Homo Sapiens
YEFNVCGKA

SEQ ID NO: 1404180 - protein, 9 aa, Homo Sapiens
LKDWAEVYV

SEQ ID NO: 1404181 - protein, 9 aa, Homo Sapiens
TYLLDTEGA

SEQ ID NO: 1404182 - protein, 9 aa, Homo Sapiens
CACASHSGI

SEQ ID NO: 1404183 - protein, 9 aa, Homo Sapiens
NEAKPIGFA

SEQ ID NO: 1404184 - protein, 9 aa, Homo Sapiens
GLSAETTEP

SEQ ID NO: 1404185 - protein, 9 aa, Homo Sapiens
AAWDAPCPL

SEQ ID NO: 1404186 - protein, 9 aa, Homo Sapiens
SIMVRIAPE

SEQ ID NO: 1404187 - protein, 9 aa, Homo Sapiens
GQPKTNKTM

SEQ ID NO: 1404188 - protein, 9 aa, Homo Sapiens
LYEWDNRRE

SEQ ID NO: 1404189 - protein, 9 aa, Homo Sapiens
TLSTLQQRH

SEQ ID NO: 1404190 - protein, 9 aa, Homo Sapiens
PHPPPKPRY

SEQ ID NO: 1404191 - protein, 9 aa, Homo Sapiens
CGAAGAREA

SEQ ID NO: 1404192 - protein, 9 aa, Homo Sapiens
QKREDEAPI

SEQ ID NO: 1404193 - protein, 9 aa, Homo Sapiens
MSPNRGVLR

SEQ ID NO: 1404194 - protein, 9 aa, Homo Sapiens
RNQASNKKD

SEQ ID NO: 1404195 - protein, 9 aa, Homo Sapiens
LSTVYDMQA

SEQ ID NO: 1404196 - protein, 9 aa, Homo Sapiens
CLRHIITVD

SEQ ID NO: 1404197 - protein, 9 aa, Homo Sapiens
ADRVLDGTH

SEQ ID NO: 1404198 - protein, 9 aa, Homo Sapiens
FVLGTAQWA

SEQ ID NO: 1404199 - protein, 9 aa, Homo Sapiens
FFFCLRGHP

SEQ ID NO: 1404200 - protein, 9 aa, Homo Sapiens
KQPPLLLEE

SEQ ID NO: 1404201 - protein, 9 aa, Homo Sapiens
LTGKMIRRQ

SEQ ID NO: 1404202 - protein, 9 aa, Homo Sapiens
LMFAALSTP

SEQ ID NO: 1404203 - protein, 9 aa, Homo Sapiens
SLWTEALWH

SEQ ID NO: 1404204 - protein, 9 aa, Homo Sapiens
AGRFAVLGT

SEQ ID NO: 1404205 - protein, 9 aa, Homo Sapiens
IHYELDYIL

SEQ ID NO: 1404206 - protein, 9 aa, Homo Sapiens
STKLAMSFL

SEQ ID NO: 1404207 - protein, 9 aa, Homo Sapiens
DERLCANLM

SEQ ID NO: 1404208 - protein, 9 aa, Homo Sapiens
LRRLIIFKG

SEQ ID NO: 1404209 - protein, 9 aa, Homo Sapiens
PPKALVKVK

SEQ ID NO: 1404210 - protein, 9 aa, Homo Sapiens
WEVQRTMLE

SEQ ID NO: 1404211 - protein, 9 aa, Homo Sapiens
TESGAALFG

SEQ ID NO: 1404212 - protein, 9 aa, Homo Sapiens
SHTGMEHSA

SEQ ID NO: 1404213 - protein, 9 aa, Homo Sapiens
RIIYSIPPA

SEQ ID NO: 1404214 - protein, 9 aa, Homo Sapiens
HFAHMFEFF

SEQ ID NO: 1404215 - protein, 9 aa, Homo Sapiens
SVLRDSLPP

SEQ ID NO: 1404216 - protein, 9 aa, Homo Sapiens
ICTAQNPIS

SEQ ID NO: 1404217 - protein, 9 aa, Homo Sapiens
PCDANTLPK

SEQ ID NO: 1404218 - protein, 9 aa, Homo Sapiens
RGEAEWHKL

SEQ ID NO: 1404219 - protein, 9 aa, Homo Sapiens
PPAFRDRNT

SEQ ID NO: 1404220 - protein, 9 aa, Homo Sapiens
KKTYMEMHY

SEQ ID NO: 1404221 - protein, 9 aa, Homo Sapiens
FHRDLFLHH

SEQ ID NO: 1404222 - protein, 9 aa, Homo Sapiens
WPKEKSKHG

SEQ ID NO: 1404223 - protein, 9 aa, Homo Sapiens
EFLMGGMSR

SEQ ID NO: 1404224 - protein, 9 aa, Homo Sapiens
DLYPLFAYM

SEQ ID NO: 1404225 - protein, 9 aa, Homo Sapiens
RHPQGPCPP

SEQ ID NO: 1404226 - protein, 9 aa, Homo Sapiens
ALGAFGGAG

SEQ ID NO: 1404227 - protein, 9 aa, Homo Sapiens
MEGNGTKNS

SEQ ID NO: 1404228 - protein, 9 aa, Homo Sapiens
SMAASGKGS

SEQ ID NO: 1404229 - protein, 9 aa, Homo Sapiens
TGTKNLRML

SEQ ID NO: 1404230 - protein, 9 aa, Homo Sapiens
QGLKMSATF

SEQ ID NO: 1404231 - protein, 9 aa, Homo Sapiens
KEIQLCQEQ

SEQ ID NO: 1404232 - protein, 9 aa, Homo Sapiens
LLLLTAVLV

SEQ ID NO: 1404233 - protein, 9 aa, Homo Sapiens
ARWSARSRA

SEQ ID NO: 1404234 - protein, 9 aa, Homo Sapiens
KSQGSQNFA

SEQ ID NO: 1404235 - protein, 9 aa, Homo Sapiens
APARSSSAL

SEQ ID NO: 1404236 - protein, 9 aa, Homo Sapiens
LKPPTPCSR

SEQ ID NO: 1404237 - protein, 9 aa, Homo Sapiens
KDLRVSEKY

SEQ ID NO: 1404238 - protein, 9 aa, Homo Sapiens
PCSRWCSGW

SEQ ID NO: 1404239 - protein, 9 aa, Homo Sapiens
LFLEVILPN

SEQ ID NO: 1404240 - protein, 9 aa, Homo Sapiens
ALVKVKQPP

SEQ ID NO: 1404241 - protein, 9 aa, Homo Sapiens
LTNTLEISN

SEQ ID NO: 1404242 - protein, 9 aa, Homo Sapiens
ILEEEEEEQ

SEQ ID NO: 1404243 - protein, 9 aa, Homo Sapiens
ALNKKWVWR

SEQ ID NO: 1404244 - protein, 9 aa, Homo Sapiens
QMSLAGREK

SEQ ID NO: 1404245 - protein, 9 aa, Homo Sapiens
MSTLLISKI

SEQ ID NO: 1404246 - protein, 9 aa, Homo Sapiens
LAEINRHCA

SEQ ID NO: 1404247 - protein, 9 aa, Homo Sapiens
RTWLSVYSA

SEQ ID NO: 1404248 - protein, 9 aa, Homo Sapiens
CPRSAVDIS

SEQ ID NO: 1404249 - protein, 9 aa, Homo Sapiens
KLTEQLKLL

SEQ ID NO: 1404250 - protein, 9 aa, Homo Sapiens
RDMHMQISN

SEQ ID NO: 1404251 - protein, 9 aa, Homo Sapiens
RLAEINRHC

SEQ ID NO: 1404252 - protein, 9 aa, Homo Sapiens
EAQAPCPGS

SEQ ID NO: 1404253 - protein, 9 aa, Homo Sapiens
VHDQDRKSE

SEQ ID NO: 1404254 - protein, 9 aa, Homo Sapiens
ALQPGEKKS

SEQ ID NO: 1404255 - protein, 9 aa, Homo Sapiens
VPVLVSSQF

SEQ ID NO: 1404256 - protein, 9 aa, Homo Sapiens
AQAHFDFSA

SEQ ID NO: 1404257 - protein, 9 aa, Homo Sapiens
HVNRLQSQR

SEQ ID NO: 1404258 - protein, 9 aa, Homo Sapiens
EHVELLQRQ

SEQ ID NO: 1404259 - protein, 9 aa, Homo Sapiens
RDSPASASL

SEQ ID NO: 1404260 - protein, 9 aa, Homo Sapiens
TALSSYARA

SEQ ID NO: 1404261 - protein, 9 aa, Homo Sapiens
SGASAAAAA

SEQ ID NO: 1404262 - protein, 9 aa, Homo Sapiens
PALRGESDM

SEQ ID NO: 1404263 - protein, 9 aa, Homo Sapiens
PQFSLGWFA

SEQ ID NO: 1404264 - protein, 9 aa, Homo Sapiens
YEMFGDEGV

SEQ ID NO: 1404265 - protein, 9 aa, Homo Sapiens
LVPCLRHII

SEQ ID NO: 1404266 - protein, 9 aa, Homo Sapiens
ICAICFGRH

SEQ ID NO: 1404267 - protein, 9 aa, Homo Sapiens
LSSWRCFSF

SEQ ID NO: 1404268 - protein, 9 aa, Homo Sapiens
PTQIRKRPC

SEQ ID NO: 1404269 - protein, 9 aa, Homo Sapiens
APWLPMRSL

SEQ ID NO: 1404270 - protein, 9 aa, Homo Sapiens
SVGPSCLKQ

SEQ ID NO: 1404271 - protein, 9 aa, Homo Sapiens
HSGMLPLEI

SEQ ID NO: 1404272 - protein, 9 aa, Homo Sapiens
TFRTARKGE

SEQ ID NO: 1404273 - protein, 9 aa, Homo Sapiens
YVAIYNHLL

SEQ ID NO: 1404274 - protein, 9 aa, Homo Sapiens
EDRPGAFIK

SEQ ID NO: 1404275 - protein, 9 aa, Homo Sapiens
EKSKHGLFW

SEQ ID NO: 1404276 - protein, 9 aa, Homo Sapiens
RLNKLPNQV

SEQ ID NO: 1404277 - protein, 9 aa, Homo Sapiens
VDLPTECSL

SEQ ID NO: 1404278 - protein, 9 aa, Homo Sapiens
WFLSVHTRV

SEQ ID NO: 1404279 - protein, 9 aa, Homo Sapiens
VEDPFHSWR

SEQ ID NO: 1404280 - protein, 9 aa, Homo Sapiens
KKQDPKGKG

SEQ ID NO: 1404281 - protein, 9 aa, Homo Sapiens
LWTEALWHR

SEQ ID NO: 1404282 - protein, 9 aa, Homo Sapiens
LGTDSSLQI

SEQ ID NO: 1404283 - protein, 9 aa, Homo Sapiens
EQFLCSEMF

SEQ ID NO: 1404284 - protein, 9 aa, Homo Sapiens
LCLCHQGYE

SEQ ID NO: 1404285 - protein, 9 aa, Homo Sapiens
HQHLCNEHF

SEQ ID NO: 1404286 - protein, 9 aa, Homo Sapiens
HHITGECSC

SEQ ID NO: 1404287 - protein, 9 aa, Homo Sapiens
SENYHIPSI

SEQ ID NO: 1404288 - protein, 9 aa, Homo Sapiens
EPFMTHSII

SEQ ID NO: 1404289 - protein, 9 aa, Homo Sapiens
YTGNMALAA

SEQ ID NO: 1404290 - protein, 9 aa, Homo Sapiens
HVAIVCTGY

SEQ ID NO: 1404291 - protein, 9 aa, Homo Sapiens
KLRRTPALT

SEQ ID NO: 1404292 - protein, 9 aa, Homo Sapiens
RVDVMKLLL

SEQ ID NO: 1404293 - protein, 9 aa, Homo Sapiens
EGRFGLLAS

SEQ ID NO: 1404294 - protein, 9 aa, Homo Sapiens
MGFKINFLT

SEQ ID NO: 1404295 - protein, 9 aa, Homo Sapiens
EFLFHRWGH

SEQ ID NO: 1404296 - protein, 9 aa, Homo Sapiens
QELAEMPPP

SEQ ID NO: 1404297 - protein, 9 aa, Homo Sapiens
KADQSESSL

SEQ ID NO: 1404298 - protein, 9 aa, Homo Sapiens
LLHERLSSC

SEQ ID NO: 1404299 - protein, 9 aa, Homo Sapiens
LWSKQLLCD

SEQ ID NO: 1404300 - protein, 9 aa, Homo Sapiens
QEKNLRDMH

SEQ ID NO: 1404301 - protein, 9 aa, Homo Sapiens
KENIFVSIA

SEQ ID NO: 1404302 - protein, 9 aa, Homo Sapiens
SCLRALFLE

SEQ ID NO: 1404303 - protein, 9 aa, Homo Sapiens
SCVVLKSSE

SEQ ID NO: 1404304 - protein, 9 aa, Homo Sapiens
VGNHEEKIL

SEQ ID NO: 1404305 - protein, 9 aa, Homo Sapiens
YVSCSHLIS

SEQ ID NO: 1404306 - protein, 9 aa, Homo Sapiens
NLLCQLWMK

SEQ ID NO: 1404307 - protein, 9 aa, Homo Sapiens
MMEGNGTKN

SEQ ID NO: 1404308 - protein, 9 aa, Homo Sapiens
HGASLQVVL

SEQ ID NO: 1404309 - protein, 9 aa, Homo Sapiens
LQQRHPQGP

SEQ ID NO: 1404310 - protein, 9 aa, Homo Sapiens
KVVLQVLAE

SEQ ID NO: 1404311 - protein, 9 aa, Homo Sapiens
DSEKAGDWE

SEQ ID NO: 1404312 - protein, 9 aa, Homo Sapiens
LLHPAGVFH

SEQ ID NO: 1404313 - protein, 9 aa, Homo Sapiens
LFGASRVDV

SEQ ID NO: 1404314 - protein, 9 aa, Homo Sapiens
KLVVVGADG

SEQ ID NO: 1404315 - protein, 9 aa, Homo Sapiens
SSTHAPARS

SEQ ID NO: 1404316 - protein, 9 aa, Homo Sapiens
DVFYLMEPV

SEQ ID NO: 1404317 - protein, 9 aa, Homo Sapiens
LNLGPCDAN

SEQ ID NO: 1404318 - protein, 9 aa, Homo Sapiens
GNSLKQIHL

SEQ ID NO: 1404319 - protein, 9 aa, Homo Sapiens
LPSAPALRG

SEQ ID NO: 1404320 - protein, 9 aa, Homo Sapiens
KSSRGTVRT

SEQ ID NO: 1404321 - protein, 9 aa, Homo Sapiens
PASWFLSVH

SEQ ID NO: 1404322 - protein, 9 aa, Homo Sapiens
FLRLDVFIL

SEQ ID NO: 1404323 - protein, 9 aa, Homo Sapiens
WVHVRCALW

SEQ ID NO: 1404324 - protein, 9 aa, Homo Sapiens
MPQFSLGWF

SEQ ID NO: 1404325 - protein, 9 aa, Homo Sapiens
TNNQHCLIE

SEQ ID NO: 1404326 - protein, 9 aa, Homo Sapiens
PNLTFMGQL

SEQ ID NO: 1404327 - protein, 9 aa, Homo Sapiens
YVWDDAVFI

SEQ ID NO: 1404328 - protein, 9 aa, Homo Sapiens
YFCDDHFQG

SEQ ID NO: 1404329 - protein, 9 aa, Homo Sapiens
SIAIEHVQS

SEQ ID NO: 1404330 - protein, 9 aa, Homo Sapiens
IGAFSLRDI

SEQ ID NO: 1404331 - protein, 9 aa, Homo Sapiens
AQRPDGEGC

SEQ ID NO: 1404332 - protein, 9 aa, Homo Sapiens
WSFMTHQEA

SEQ ID NO: 1404333 - protein, 9 aa, Homo Sapiens
RASHMMTFF

SEQ ID NO: 1404334 - protein, 9 aa, Homo Sapiens
IVCTGYNAS

SEQ ID NO: 1404335 - protein, 9 aa, Homo Sapiens
EINRHCAGR

SEQ ID NO: 1404336 - protein, 9 aa, Homo Sapiens
AKKKLEKKQ

SEQ ID NO: 1404337 - protein, 9 aa, Homo Sapiens
GEVQCTPQP

SEQ ID NO: 1404338 - protein, 9 aa, Homo Sapiens
RFPTTESGA

SEQ ID NO: 1404339 - protein, 9 aa, Homo Sapiens
VGPWVRFPK

SEQ ID NO: 1404340 - protein, 9 aa, Homo Sapiens
MAMVDIVKR

SEQ ID NO: 1404341 - protein, 9 aa, Homo Sapiens
IHSSGLLSG

SEQ ID NO: 1404342 - protein, 9 aa, Homo Sapiens
LLLTAVLVL

SEQ ID NO: 1404343 - protein, 9 aa, Homo Sapiens
VEFDGGIVM

SEQ ID NO: 1404344 - protein, 9 aa, Homo Sapiens
HNSKLTKVQ

SEQ ID NO: 1404345 - protein, 9 aa, Homo Sapiens
FRIYKDYIW

SEQ ID NO: 1404346 - protein, 9 aa, Homo Sapiens
TVTIKIALN

SEQ ID NO: 1404347 - protein, 9 aa, Homo Sapiens
WQVMASLTG

SEQ ID NO: 1404348 - protein, 9 aa, Homo Sapiens
LDLQRCASL

SEQ ID NO: 1404349 - protein, 9 aa, Homo Sapiens
FALILNRHE

SEQ ID NO: 1404350 - protein, 9 aa, Homo Sapiens
GSEATSQYY

SEQ ID NO: 1404351 - protein, 9 aa, Homo Sapiens
LPQHALVCL

SEQ ID NO: 1404352 - protein, 9 aa, Homo Sapiens
SPNLTFMGQ

SEQ ID NO: 1404353 - protein, 9 aa, Homo Sapiens
QEQFLCSEM

SEQ ID NO: 1404354 - protein, 9 aa, Homo Sapiens
IRLSAENVP

SEQ ID NO: 1404355 - protein, 9 aa, Homo Sapiens
GQQPAATAS

SEQ ID NO: 1404356 - protein, 9 aa, Homo Sapiens
LRLFAVLKQ

SEQ ID NO: 1404357 - protein, 9 aa, Homo Sapiens
SKKAHPLRL

SEQ ID NO: 1404358 - protein, 9 aa, Homo Sapiens
GPDPKYPQD

SEQ ID NO: 1404359 - protein, 9 aa, Homo Sapiens
GQHFDPNTY

SEQ ID NO: 1404360 - protein, 9 aa, Homo Sapiens
SPKRPFQCI

SEQ ID NO: 1404361 - protein, 9 aa, Homo Sapiens
SPDGMPVIY

SEQ ID NO: 1404362 - protein, 9 aa, Homo Sapiens
PQEILRDST

SEQ ID NO: 1404363 - protein, 9 aa, Homo Sapiens
INTEPAVDY

SEQ ID NO: 1404364 - protein, 9 aa, Homo Sapiens
EAADRMPQF

SEQ ID NO: 1404365 - protein, 9 aa, Homo Sapiens
EPTTGMLAN

SEQ ID NO: 1404366 - protein, 9 aa, Homo Sapiens
VIPPILLPA

SEQ ID NO: 1404367 - protein, 9 aa, Homo Sapiens
VGTTSDILT

SEQ ID NO: 1404368 - protein, 9 aa, Homo Sapiens
IVSLVPCLR

SEQ ID NO: 1404369 - protein, 9 aa, Homo Sapiens
SSIVQKLKK

SEQ ID NO: 1404370 - protein, 9 aa, Homo Sapiens
WLIKPQWKQ

SEQ ID NO: 1404371 - protein, 9 aa, Homo Sapiens
WITHLDRLV

SEQ ID NO: 1404372 - protein, 9 aa, Homo Sapiens
ILRDSTNFL

SEQ ID NO: 1404373 - protein, 9 aa, Homo Sapiens
GRRANTSAL

SEQ ID NO: 1404374 - protein, 9 aa, Homo Sapiens
SENQANNLL

SEQ ID NO: 1404375 - protein, 9 aa, Homo Sapiens
VEFSTLPVG

SEQ ID NO: 1404376 - protein, 9 aa, Homo Sapiens
GKNQDLTSL

SEQ ID NO: 1404377 - protein, 9 aa, Homo Sapiens
AAAADAAAA

SEQ ID NO: 1404378 - protein, 9 aa, Homo Sapiens
CLCHQGYEL

SEQ ID NO: 1404379 - protein, 9 aa, Homo Sapiens
QPSSLTANM

SEQ ID NO: 1404380 - protein, 9 aa, Homo Sapiens
EVFTLFLVM

SEQ ID NO: 1404381 - protein, 9 aa, Homo Sapiens
DVFILLHPA

SEQ ID NO: 1404382 - protein, 9 aa, Homo Sapiens
IPLLFTATS

SEQ ID NO: 1404383 - protein, 9 aa, Homo Sapiens
PKRPEQLPQ

SEQ ID NO: 1404384 - protein, 9 aa, Homo Sapiens
PLLFTATSS

SEQ ID NO: 1404385 - protein, 9 aa, Homo Sapiens
SSRGTVRTQ

SEQ ID NO: 1404386 - protein, 9 aa, Homo Sapiens
RRHGERDCR

SEQ ID NO: 1404387 - protein, 9 aa, Homo Sapiens
SPNRGVLRS

SEQ ID NO: 1404388 - protein, 9 aa, Homo Sapiens
VESGVLMLV

SEQ ID NO: 1404389 - protein, 9 aa, Homo Sapiens
AGTHQVQNA

SEQ ID NO: 1404390 - protein, 9 aa, Homo Sapiens
PSGRLEIYR

SEQ ID NO: 1404391 - protein, 9 aa, Homo Sapiens
SVAIGKLAL

SEQ ID NO: 1404392 - protein, 9 aa, Homo Sapiens
PSKWITHLD

SEQ ID NO: 1404393 - protein, 9 aa, Homo Sapiens
LRRARHDPP

SEQ ID NO: 1404394 - protein, 9 aa, Homo Sapiens
FSPNFAQVT

SEQ ID NO: 1404395 - protein, 9 aa, Homo Sapiens
PGLLPLCCP

SEQ ID NO: 1404396 - protein, 9 aa, Homo Sapiens
DLMTICGLT

SEQ ID NO: 1404397 - protein, 9 aa, Homo Sapiens
QSSFNICGS

SEQ ID NO: 1404398 - protein, 9 aa, Homo Sapiens
KVYTEEKSH

SEQ ID NO: 1404399 - protein, 9 aa, Homo Sapiens
PKKKKVWSF

SEQ ID NO: 1404400 - protein, 9 aa, Homo Sapiens
GSNPPIFHS

SEQ ID NO: 1404401 - protein, 9 aa, Homo Sapiens
HGSPFTAKI

SEQ ID NO: 1404402 - protein, 9 aa, Homo Sapiens
TVYVESICR

SEQ ID NO: 1404403 - protein, 9 aa, Homo Sapiens
EAASSHRLR

SEQ ID NO: 1404404 - protein, 9 aa, Homo Sapiens
ATPAPLLAV

SEQ ID NO: 1404405 - protein, 9 aa, Homo Sapiens
EPSGSSSKI

SEQ ID NO: 1404406 - protein, 9 aa, Homo Sapiens
SAEMTGLGK

SEQ ID NO: 1404407 - protein, 9 aa, Homo Sapiens
EKPYEFNVC

SEQ ID NO: 1404408 - protein, 9 aa, Homo Sapiens
QQTGVHGFA

SEQ ID NO: 1404409 - protein, 9 aa, Homo Sapiens
GAFSLRDIQ

SEQ ID NO: 1404410 - protein, 9 aa, Homo Sapiens
TAIGATVIL

SEQ ID NO: 1404411 - protein, 9 aa, Homo Sapiens
IFADNSGMD

SEQ ID NO: 1404412 - protein, 9 aa, Homo Sapiens
SVLHANSGP

SEQ ID NO: 1404413 - protein, 9 aa, Homo Sapiens
LVALDRYVA

SEQ ID NO: 1404414 - protein, 9 aa, Homo Sapiens
RDLFRVVTL

SEQ ID NO: 1404415 - protein, 9 aa, Homo Sapiens
SQRTIGKNS

SEQ ID NO: 1404416 - protein, 9 aa, Homo Sapiens
VSQRTIGKN

SEQ ID NO: 1404417 - protein, 9 aa, Homo Sapiens
KAPSPRVAH

SEQ ID NO: 1404418 - protein, 9 aa, Homo Sapiens
DIPTYNRTS

SEQ ID NO: 1404419 - protein, 9 aa, Homo Sapiens
PYVCHTELN

SEQ ID NO: 1404420 - protein, 9 aa, Homo Sapiens
QNLRPNIPN

SEQ ID NO: 1404421 - protein, 9 aa, Homo Sapiens
TYNRTSGNS

SEQ ID NO: 1404422 - protein, 9 aa, Homo Sapiens
TEPAVDYTL

SEQ ID NO: 1404423 - protein, 9 aa, Homo Sapiens
TASASRPSR

SEQ ID NO: 1404424 - protein, 9 aa, Homo Sapiens
LKSGWHRVG

SEQ ID NO: 1404425 - protein, 9 aa, Homo Sapiens
LSGLPGLFD

SEQ ID NO: 1404426 - protein, 9 aa, Homo Sapiens
PFIVSMRYF

SEQ ID NO: 1404427 - protein, 9 aa, Homo Sapiens
KLRWIRIIP

SEQ ID NO: 1404428 - protein, 9 aa, Homo Sapiens
KATVFLNPV

SEQ ID NO: 1404429 - protein, 9 aa, Homo Sapiens
EQNLRPNIP

SEQ ID NO: 1404430 - protein, 9 aa, Homo Sapiens
TVHVVNATV

SEQ ID NO: 1404431 - protein, 9 aa, Homo Sapiens
TPLSISRPT

SEQ ID NO: 1404432 - protein, 9 aa, Homo Sapiens
PKGKGHRRK

SEQ ID NO: 1404433 - protein, 9 aa, Homo Sapiens
NLLGCLWSG

SEQ ID NO: 1404434 - protein, 9 aa, Homo Sapiens
DNRAKLRWI

SEQ ID NO: 1404435 - protein, 9 aa, Homo Sapiens
PQLVIKEDE

SEQ ID NO: 1404436 - protein, 9 aa, Homo Sapiens
QGTTEPFMT

SEQ ID NO: 1404437 - protein, 9 aa, Homo Sapiens
LTKVQAEIC

SEQ ID NO: 1404438 - protein, 9 aa, Homo Sapiens
SAPEASHDT

SEQ ID NO: 1404439 - protein, 9 aa, Homo Sapiens
VYGIQIYML

SEQ ID NO: 1404440 - protein, 9 aa, Homo Sapiens
AVAWAAAPT

SEQ ID NO: 1404441 - protein, 9 aa, Homo Sapiens
QQSLQAVNK

SEQ ID NO: 1404442 - protein, 9 aa, Homo Sapiens
SEDGSGKGR

SEQ ID NO: 1404443 - protein, 9 aa, Homo Sapiens
ALAAIAVHL

SEQ ID NO: 1404444 - protein, 9 aa, Homo Sapiens
GDIVTVVAG

SEQ ID NO: 1404445 - protein, 9 aa, Homo Sapiens
LLHLVAEVE

SEQ ID NO: 1404446 - protein, 9 aa, Homo Sapiens
ETSSIVQKL

SEQ ID NO: 1404447 - protein, 9 aa, Homo Sapiens
TSLPGPNQI

SEQ ID NO: 1404448 - protein, 9 aa, Homo Sapiens
QAGDGHGRL

SEQ ID NO: 1404449 - protein, 9 aa, Homo Sapiens
KPNMPFIVS

SEQ ID NO: 1404450 - protein, 9 aa, Homo Sapiens
LYPLFAYML

SEQ ID NO: 1404451 - protein, 9 aa, Homo Sapiens
HMVIASRSL

SEQ ID NO: 1404452 - protein, 9 aa, Homo Sapiens
ERNAKRMES

SEQ ID NO: 1404453 - protein, 9 aa, Homo Sapiens
LLQGLWRKV

SEQ ID NO: 1404454 - protein, 9 aa, Homo Sapiens
STGSLTNQS

SEQ ID NO: 1404455 - protein, 9 aa, Homo Sapiens
TSIKVVKKA

SEQ ID NO: 1404456 - protein, 9 aa, Homo Sapiens
SKKSTRPSG

SEQ ID NO: 1404457 - protein, 9 aa, Homo Sapiens
VGSIDICHQ

SEQ ID NO: 1404458 - protein, 9 aa, Homo Sapiens
TEFVITLIS

SEQ ID NO: 1404459 - protein, 9 aa, Homo Sapiens
KNTREGGWT

SEQ ID NO: 1404460 - protein, 9 aa, Homo Sapiens
RGPSQVGGR

SEQ ID NO: 1404461 - protein, 9 aa, Homo Sapiens
YEKMFPWMV

SEQ ID NO: 1404462 - protein, 9 aa, Homo Sapiens
HLLAFESHH

SEQ ID NO: 1404463 - protein, 9 aa, Homo Sapiens
SRLVCGRHS

SEQ ID NO: 1404464 - protein, 9 aa, Homo Sapiens
LGTSPVKGL

SEQ ID NO: 1404465 - protein, 9 aa, Homo Sapiens
QNPISQRSS

SEQ ID NO: 1404466 - protein, 9 aa, Homo Sapiens
NGGTPDIHS

SEQ ID NO: 1404467 - protein, 9 aa, Homo Sapiens
CHNKQVEGH

SEQ ID NO: 1404468 - protein, 9 aa, Homo Sapiens
AASTPSSTH

SEQ ID NO: 1404469 - protein, 9 aa, Homo Sapiens
EITDDLDVG

SEQ ID NO: 1404470 - protein, 9 aa, Homo Sapiens
ESVLHANSG

SEQ ID NO: 1404471 - protein, 9 aa, Homo Sapiens
AKRYVGSID

SEQ ID NO: 1404472 - protein, 9 aa, Homo Sapiens
FLTLRHLMW

SEQ ID NO: 1404473 - protein, 9 aa, Homo Sapiens
RSSLLWPAA

SEQ ID NO: 1404474 - protein, 9 aa, Homo Sapiens
DVEAADRMP

SEQ ID NO: 1404475 - protein, 9 aa, Homo Sapiens
VEHNLKSLM

SEQ ID NO: 1404476 - protein, 9 aa, Homo Sapiens
PSLATVQPQ

SEQ ID NO: 1404477 - protein, 9 aa, Homo Sapiens
TVYDMQALH

SEQ ID NO: 1404478 - protein, 9 aa, Homo Sapiens
SEATSQYYF

SEQ ID NO: 1404479 - protein, 9 aa, Homo Sapiens
IGFSLAKTW

SEQ ID NO: 1404480 - protein, 9 aa, Homo Sapiens
PQAAGAERE

SEQ ID NO: 1404481 - protein, 9 aa, Homo Sapiens
HRKVYTEEK

SEQ ID NO: 1404482 - protein, 9 aa, Homo Sapiens
IQFKQLAYL

SEQ ID NO: 1404483 - protein, 9 aa, Homo Sapiens
SPHLAMAAL

SEQ ID NO: 1404484 - protein, 9 aa, Homo Sapiens
QVAEDRPGA

SEQ ID NO: 1404485 - protein, 9 aa, Homo Sapiens
VVRFLSGLV

SEQ ID NO: 1404486 - protein, 9 aa, Homo Sapiens
TNQLMGLAG

SEQ ID NO: 1404487 - protein, 9 aa, Homo Sapiens
KSKKGPPVK

SEQ ID NO: 1404488 - protein, 9 aa, Homo Sapiens
LHLVAEVEE

SEQ ID NO: 1404489 - protein, 9 aa, Homo Sapiens
QEDAKALWD

SEQ ID NO: 1404490 - protein, 9 aa, Homo Sapiens
HNKQVEGHV

SEQ ID NO: 1404491 - protein, 9 aa, Homo Sapiens
AMLPKLLCR

SEQ ID NO: 1404492 - protein, 9 aa, Homo Sapiens
ELLNGIRTM

SEQ ID NO: 1404493 - protein, 9 aa, Homo Sapiens
AGVFHIGPV

SEQ ID NO: 1404494 - protein, 9 aa, Homo Sapiens
PTSRARQSC

SEQ ID NO: 1404495 - protein, 9 aa, Homo Sapiens
YHIPSIAGA

SEQ ID NO: 1404496 - protein, 9 aa, Homo Sapiens
KQKKRQQDR

SEQ ID NO: 1404497 - protein, 9 aa, Homo Sapiens
LQVVLEHLR

SEQ ID NO: 1404498 - protein, 9 aa, Homo Sapiens
EELNLGPCD

SEQ ID NO: 1404499 - protein, 9 aa, Homo Sapiens
DRNSVGPSC

SEQ ID NO: 1404500 - protein, 9 aa, Homo Sapiens
SCHQHLCNE

SEQ ID NO: 1404501 - protein, 9 aa, Homo Sapiens
QRPRPTKNT

SEQ ID NO: 1404502 - protein, 9 aa, Homo Sapiens
IEEFGQLKS

SEQ ID NO: 1404503 - protein, 9 aa, Homo Sapiens
FLEVILPNP

SEQ ID NO: 1404504 - protein, 9 aa, Homo Sapiens
HALEKSYKC

SEQ ID NO: 1404505 - protein, 9 aa, Homo Sapiens
IRFAPQLVI

SEQ ID NO: 1404506 - protein, 9 aa, Homo Sapiens
NGYWVLRPT

SEQ ID NO: 1404507 - protein, 9 aa, Homo Sapiens
SPFSTVCRE

SEQ ID NO: 1404508 - protein, 9 aa, Homo Sapiens
CQHFDTLRM

SEQ ID NO: 1404509 - protein, 9 aa, Homo Sapiens
KIGLETIGV

SEQ ID NO: 1404510 - protein, 9 aa, Homo Sapiens
ESTHNGNNA

SEQ ID NO: 1404511 - protein, 9 aa, Homo Sapiens
EEDIGQSEQ

SEQ ID NO: 1404512 - protein, 9 aa, Homo Sapiens
RPSGSFLSS

SEQ ID NO: 1404513 - protein, 9 aa, Homo Sapiens
LVETLLDEK

SEQ ID NO: 1404514 - protein, 9 aa, Homo Sapiens
AKPSATSQE

SEQ ID NO: 1404515 - protein, 9 aa, Homo Sapiens
CSLAIEIFH

SEQ ID NO: 1404516 - protein, 9 aa, Homo Sapiens
QKSQGSQNF

SEQ ID NO: 1404517 - protein, 9 aa, Homo Sapiens
DKEATICQN

SEQ ID NO: 1404518 - protein, 9 aa, Homo Sapiens
ERTHSTFED

SEQ ID NO: 1404519 - protein, 9 aa, Homo Sapiens
SGRLEIYRN

SEQ ID NO: 1404520 - protein, 9 aa, Homo Sapiens
LKENLKDTT

SEQ ID NO: 1404521 - protein, 9 aa, Homo Sapiens
RLCQSLGNS

SEQ ID NO: 1404522 - protein, 9 aa, Homo Sapiens
CSVCSCQNE

SEQ ID NO: 1404523 - protein, 9 aa, Homo Sapiens
HRDQSETQE

SEQ ID NO: 1404524 - protein, 9 aa, Homo Sapiens
EKHVERLEL

SEQ ID NO: 1404525 - protein, 9 aa, Homo Sapiens
KTIQCQSSF

SEQ ID NO: 1404526 - protein, 9 aa, Homo Sapiens
LRMTKPEPA

SEQ ID NO: 1404527 - protein, 9 aa, Homo Sapiens
VALRRVLLD

SEQ ID NO: 1404528 - protein, 9 aa, Homo Sapiens
LNRYVAICD

SEQ ID NO: 1404529 - protein, 9 aa, Homo Sapiens
GRVDQPLHS

SEQ ID NO: 1404530 - protein, 9 aa, Homo Sapiens
AKTWCRCDS

SEQ ID NO: 1404531 - protein, 9 aa, Homo Sapiens
TRLHVTWSM

SEQ ID NO: 1404532 - protein, 9 aa, Homo Sapiens
DGQGRVVPV

SEQ ID NO: 1404533 - protein, 9 aa, Homo Sapiens
LSRGILVLR

SEQ ID NO: 1404534 - protein, 9 aa, Homo Sapiens
CVPFLEILR

SEQ ID NO: 1404535 - protein, 9 aa, Homo Sapiens
RGVLRSLAA

SEQ ID NO: 1404536 - protein, 9 aa, Homo Sapiens
PFLEILRRS

SEQ ID NO: 1404537 - protein, 9 aa, Homo Sapiens
TPVPVACPD

SEQ ID NO: 1404538 - protein, 9 aa, Homo Sapiens
STCYHQAAS

SEQ ID NO: 1404539 - protein, 9 aa, Homo Sapiens
LKKQFLPPK

SEQ ID NO: 1404540 - protein, 9 aa, Homo Sapiens
APVHETCAQ

SEQ ID NO: 1404541 - protein, 9 aa, Homo Sapiens
ARQSCCLPG

SEQ ID NO: 1404542 - protein, 9 aa, Homo Sapiens
GFQWGESPW

SEQ ID NO: 1404543 - protein, 9 aa, Homo Sapiens
QEEELTAEE

SEQ ID NO: 1404544 - protein, 9 aa, Homo Sapiens
STEGLARLC

SEQ ID NO: 1404545 - protein, 9 aa, Homo Sapiens
ELEALKQMS

SEQ ID NO: 1404546 - protein, 9 aa, Homo Sapiens
LGLHDNDSR

SEQ ID NO: 1404547 - protein, 9 aa, Homo Sapiens
MRSLGEPWR

SEQ ID NO: 1404548 - protein, 9 aa, Homo Sapiens
ILGIKKVIT

SEQ ID NO: 1404549 - protein, 9 aa, Homo Sapiens
RFGKHVPRV

SEQ ID NO: 1404550 - protein, 9 aa, Homo Sapiens
VMLHINCKV

SEQ ID NO: 1404551 - protein, 9 aa, Homo Sapiens
QAIAVQAGD

SEQ ID NO: 1404552 - protein, 9 aa, Homo Sapiens
IGLHGVDGD

SEQ ID NO: 1404553 - protein, 9 aa, Homo Sapiens
RLVASKSQT

SEQ ID NO: 1404554 - protein, 9 aa, Homo Sapiens
IIFKGARYY

SEQ ID NO: 1404555 - protein, 9 aa, Homo Sapiens
SVEELQGGL

SEQ ID NO: 1404556 - protein, 9 aa, Homo Sapiens
LFLEHEGNF

SEQ ID NO: 1404557 - protein, 9 aa, Homo Sapiens
LRLDVFILL

SEQ ID NO: 1404558 - protein, 9 aa, Homo Sapiens
SDLIIRAKF

SEQ ID NO: 1404559 - protein, 9 aa, Homo Sapiens
GQRDLFRVV

SEQ ID NO: 1404560 - protein, 9 aa, Homo Sapiens
LILNRHEYP

SEQ ID NO: 1404561 - protein, 9 aa, Homo Sapiens
VLDLQRCAS

SEQ ID NO: 1404562 - protein, 9 aa, Homo Sapiens
AYMLTARSW

SEQ ID NO: 1404563 - protein, 9 aa, Homo Sapiens
KAVYEKMFP

SEQ ID NO: 1404564 - protein, 9 aa, Homo Sapiens
MALNRYVAI

SEQ ID NO: 1404565 - protein, 9 aa, Homo Sapiens
VRDIKIQIE

SEQ ID NO: 1404566 - protein, 9 aa, Homo Sapiens
EMVCMVRAA

SEQ ID NO: 1404567 - protein, 9 aa, Homo Sapiens
TRCQAVVQY

SEQ ID NO: 1404568 - protein, 9 aa, Homo Sapiens
AGPLLHLVA

SEQ ID NO: 1404569 - protein, 9 aa, Homo Sapiens
NRCRIGFSL

SEQ ID NO: 1404570 - protein, 9 aa, Homo Sapiens
MPPCSPSSP

SEQ ID NO: 1404571 - protein, 9 aa, Homo Sapiens
RQFLLTFQR

SEQ ID NO: 1404572 - protein, 9 aa, Homo Sapiens
LKQLSPVRA

SEQ ID NO: 1404573 - protein, 9 aa, Homo Sapiens
ENPAVAKKT

SEQ ID NO: 1404574 - protein, 9 aa, Homo Sapiens
IQIYMLDEH

SEQ ID NO: 1404575 - protein, 9 aa, Homo Sapiens
ISENYHIPS

SEQ ID NO: 1404576 - protein, 9 aa, Homo Sapiens
VWYSWRRGQ

SEQ ID NO: 1404577 - protein, 9 aa, Homo Sapiens
CGTSQTYFG

SEQ ID NO: 1404578 - protein, 9 aa, Homo Sapiens
VTVFKGSKN

SEQ ID NO: 1404579 - protein, 9 aa, Homo Sapiens
GQLPGLLPL

SEQ ID NO: 1404580 - protein, 9 aa, Homo Sapiens
SLPINPSYL

SEQ ID NO: 1404581 - protein, 9 aa, Homo Sapiens
LNHSLHITQ

SEQ ID NO: 1404582 - protein, 9 aa, Homo Sapiens
WTEALWHRA

SEQ ID NO: 1404583 - protein, 9 aa, Homo Sapiens
NEWFEHMNS

SEQ ID NO: 1404584 - protein, 9 aa, Homo Sapiens
SLTNCTFVT

SEQ ID NO: 1404585 - protein, 9 aa, Homo Sapiens
LTKHHWLIL

SEQ ID NO: 1404586 - protein, 9 aa, Homo Sapiens
GLTHPAHQP

SEQ ID NO: 1404587 - protein, 9 aa, Homo Sapiens
PIQFKQLAY

SEQ ID NO: 1404588 - protein, 9 aa, Homo Sapiens
MIQKVIQNI

SEQ ID NO: 1404589 - protein, 9 aa, Homo Sapiens
FLFLFLLLL

SEQ ID NO: 1404590 - protein, 9 aa, Homo Sapiens
IGVKINEKT

SEQ ID NO: 1404591 - protein, 9 aa, Homo Sapiens
YLRKSDLEV

SEQ ID NO: 1404592 - protein, 9 aa, Homo Sapiens
KSTRPSGSF

SEQ ID NO: 1404593 - protein, 9 aa, Homo Sapiens
QYYFRIASS

SEQ ID NO: 1404594 - protein, 9 aa, Homo Sapiens
CRSAGDDCE

SEQ ID NO: 1404595 - protein, 9 aa, Homo Sapiens
VSAALWPLG

SEQ ID NO: 1404596 - protein, 9 aa, Homo Sapiens
SFWKRKSTS

SEQ ID NO: 1404597 - protein, 9 aa, Homo Sapiens
SVHLYFCDD

SEQ ID NO: 1404598 - protein, 9 aa, Homo Sapiens
GWATSTAAS

SEQ ID NO: 1404599 - protein, 9 aa, Homo Sapiens
TNKTMGFKI

SEQ ID NO: 1404600 - protein, 9 aa, Homo Sapiens
ASIWTWSCW

SEQ ID NO: 1404601 - protein, 9 aa, Homo Sapiens
LKIKGLTRC

SEQ ID NO: 1404602 - protein, 9 aa, Homo Sapiens
FGGAEGQPP

SEQ ID NO: 1404603 - protein, 9 aa, Homo Sapiens
GVALGAFGG

SEQ ID NO: 1404604 - protein, 9 aa, Homo Sapiens
IYFQSRLVC

SEQ ID NO: 1404605 - protein, 9 aa, Homo Sapiens
YNHLLYSVS

SEQ ID NO: 1404606 - protein, 9 aa, Homo Sapiens
WSGPTSAAS

SEQ ID NO: 1404607 - protein, 9 aa, Homo Sapiens
EHMNSVPQK

SEQ ID NO: 1404608 - protein, 9 aa, Homo Sapiens
VQSVLLLGV

SEQ ID NO: 1404609 - protein, 9 aa, Homo Sapiens
VDGDGQGRV

SEQ ID NO: 1404610 - protein, 9 aa, Homo Sapiens
GGIVMGSDS

SEQ ID NO: 1404611 - protein, 9 aa, Homo Sapiens
CKLEPEPCL

SEQ ID NO: 1404612 - protein, 9 aa, Homo Sapiens
TFLCLCHQG

SEQ ID NO: 1404613 - protein, 9 aa, Homo Sapiens
GGAAQLNVF

SEQ ID NO: 1404614 - protein, 9 aa, Homo Sapiens
WQEFIDGIL

SEQ ID NO: 1404615 - protein, 9 aa, Homo Sapiens
TPVDSKTQA

SEQ ID NO: 1404616 - protein, 9 aa, Homo Sapiens
EIQLCQEQF

SEQ ID NO: 1404617 - protein, 9 aa, Homo Sapiens
SDLSRGILV

SEQ ID NO: 1404618 - protein, 9 aa, Homo Sapiens
AGGQQERDQ

SEQ ID NO: 1404619 - protein, 9 aa, Homo Sapiens
ELHILDVKD

SEQ ID NO: 1404620 - protein, 9 aa, Homo Sapiens
MCEEFPLSG

SEQ ID NO: 1404621 - protein, 9 aa, Homo Sapiens
SEKYLLAMV

SEQ ID NO: 1404622 - protein, 9 aa, Homo Sapiens
MDIILGVFP

SEQ ID NO: 1404623 - protein, 9 aa, Homo Sapiens
NSNINPRQT

SEQ ID NO: 1404624 - protein, 9 aa, Homo Sapiens
FNNLKNCIY

SEQ ID NO: 1404625 - protein, 9 aa, Homo Sapiens
AENVPCIVT

SEQ ID NO: 1404626 - protein, 9 aa, Homo Sapiens
EEAIKKTWT

SEQ ID NO: 1404627 - protein, 9 aa, Homo Sapiens
FFSGWISGS

SEQ ID NO: 1404628 - protein, 9 aa, Homo Sapiens
FAIHQEDAK

SEQ ID NO: 1404629 - protein, 9 aa, Homo Sapiens
GASLQVVLE

SEQ ID NO: 1404630 - protein, 9 aa, Homo Sapiens
PVPVACPDD

SEQ ID NO: 1404631 - protein, 9 aa, Homo Sapiens
AALPKKKKV

SEQ ID NO: 1404632 - protein, 9 aa, Homo Sapiens
SDHQSQEPS

SEQ ID NO: 1404633 - protein, 9 aa, Homo Sapiens
DWDVYHGQG

SEQ ID NO: 1404634 - protein, 9 aa, Homo Sapiens
LHLTPTQIR

SEQ ID NO: 1404635 - protein, 9 aa, Homo Sapiens
KRQQDRMVE

SEQ ID NO: 1404636 - protein, 9 aa, Homo Sapiens
TAASTPSST

SEQ ID NO: 1404637 - protein, 9 aa, Homo Sapiens
SNKSPASAS

SEQ ID NO: 1404638 - protein, 9 aa, Homo Sapiens
LQGLWRKVQ

SEQ ID NO: 1404639 - protein, 9 aa, Homo Sapiens
LQAVNKSGT

SEQ ID NO: 1404640 - protein, 9 aa, Homo Sapiens
NDDKNTYIH

SEQ ID NO: 1404641 - protein, 9 aa, Homo Sapiens
SAQPAARAT

SEQ ID NO: 1404642 - protein, 9 aa, Homo Sapiens
DDPMLPSHD

SEQ ID NO: 1404643 - protein, 9 aa, Homo Sapiens
AAAAVAWAA

SEQ ID NO: 1404644 - protein, 9 aa, Homo Sapiens
KIIYTMLAS

SEQ ID NO: 1404645 - protein, 9 aa, Homo Sapiens
WRNQASNKK

SEQ ID NO: 1404646 - protein, 9 aa, Homo Sapiens
SNEGGRWKE

SEQ ID NO: 1404647 - protein, 9 aa, Homo Sapiens
VDYTLTQMG

SEQ ID NO: 1404648 - protein, 9 aa, Homo Sapiens
HVELLQRQW

SEQ ID NO: 1404649 - protein, 9 aa, Homo Sapiens
YDVIDKDTP

SEQ ID NO: 1404650 - protein, 9 aa, Homo Sapiens
VRFLSGLVN

SEQ ID NO: 1404651 - protein, 9 aa, Homo Sapiens
STDTSKHIK

SEQ ID NO: 1404652 - protein, 9 aa, Homo Sapiens
EHVNRLQSQ

SEQ ID NO: 1404653 - protein, 9 aa, Homo Sapiens
PHQMKCLTA

SEQ ID NO: 1404654 - protein, 9 aa, Homo Sapiens
MSRTPPRRV

SEQ ID NO: 1404655 - protein, 9 aa, Homo Sapiens
LHLDMALRQ

SEQ ID NO: 1404656 - protein, 9 aa, Homo Sapiens
AVDNLVVVH

SEQ ID NO: 1404657 - protein, 9 aa, Homo Sapiens
IGFAMYTTC

SEQ ID NO: 1404658 - protein, 9 aa, Homo Sapiens
SLTYNIANN

SEQ ID NO: 1404659 - protein, 9 aa, Homo Sapiens
RLCWCKMPH

SEQ ID NO: 1404660 - protein, 9 aa, Homo Sapiens
LPGVLIPHG

SEQ ID NO: 1404661 - protein, 9 aa, Homo Sapiens
AHFDFSAQD

SEQ ID NO: 1404662 - protein, 9 aa, Homo Sapiens
VGGRLVLKA

SEQ ID NO: 1404663 - protein, 9 aa, Homo Sapiens
PDFSKVGPW

SEQ ID NO: 1404664 - protein, 9 aa, Homo Sapiens
LAKTWCRCD

SEQ ID NO: 1404665 - protein, 9 aa, Homo Sapiens
QFPNIKSRI

SEQ ID NO: 1404666 - protein, 9 aa, Homo Sapiens
VFSFFFCLR

SEQ ID NO: 1404667 - protein, 9 aa, Homo Sapiens
CRAGASASR

SEQ ID NO: 1404668 - protein, 9 aa, Homo Sapiens
GRLAWVENA

SEQ ID NO: 1404669 - protein, 9 aa, Homo Sapiens
PPGMAQRPD

SEQ ID NO: 1404670 - protein, 9 aa, Homo Sapiens
IYAVENEHV

SEQ ID NO: 1404671 - protein, 9 aa, Homo Sapiens
GKGHRRKEI

SEQ ID NO: 1404672 - protein, 9 aa, Homo Sapiens
VGKVCRRPE

SEQ ID NO: 1404673 - protein, 9 aa, Homo Sapiens
SPPQAAGAE

SEQ ID NO: 1404674 - protein, 9 aa, Homo Sapiens
PGLQGSPHV

SEQ ID NO: 1404675 - protein, 9 aa, Homo Sapiens
PAFRDRNTR

SEQ ID NO: 1404676 - protein, 9 aa, Homo Sapiens
NEHFTPSCF

SEQ ID NO: 1404677 - protein, 9 aa, Homo Sapiens
VGVSGSSTG

SEQ ID NO: 1404678 - protein, 9 aa, Homo Sapiens
RTASASRPS

SEQ ID NO: 1404679 - protein, 9 aa, Homo Sapiens
LQGSPHVTL

SEQ ID NO: 1404680 - protein, 9 aa, Homo Sapiens
GHLDRVAAL

SEQ ID NO: 1404681 - protein, 9 aa, Homo Sapiens
EMFRLYRHM

SEQ ID NO: 1404682 - protein, 9 aa, Homo Sapiens
VCHTELNAI

SEQ ID NO: 1404683 - protein, 9 aa, Homo Sapiens
GHAGTHQVQ

SEQ ID NO: 1404684 - protein, 9 aa, Homo Sapiens
APSPRVAHA

SEQ ID NO: 1404685 - protein, 9 aa, Homo Sapiens
PPLLLEEPS

SEQ ID NO: 1404686 - protein, 9 aa, Homo Sapiens
SPGPTSPSL

SEQ ID NO: 1404687 - protein, 9 aa, Homo Sapiens
CQICFNSQS

SEQ ID NO: 1404688 - protein, 9 aa, Homo Sapiens
LHINCKVNG

SEQ ID NO: 1404689 - protein, 9 aa, Homo Sapiens
HYFRNKLIV

SEQ ID NO: 1404690 - protein, 9 aa, Homo Sapiens
KVVCEQNLR

SEQ ID NO: 1404691 - protein, 9 aa, Homo Sapiens
YNRTSGNSW

SEQ ID NO: 1404692 - protein, 9 aa, Homo Sapiens
EVARWVVFC

SEQ ID NO: 1404693 - protein, 9 aa, Homo Sapiens
IDSNHTEFV

SEQ ID NO: 1404694 - protein, 9 aa, Homo Sapiens
LLGRSWKLL

SEQ ID NO: 1404695 - protein, 9 aa, Homo Sapiens
THSTFEDFP

SEQ ID NO: 1404696 - protein, 9 aa, Homo Sapiens
DTEQPPHLP

SEQ ID NO: 1404697 - protein, 9 aa, Homo Sapiens
ISPGPTSPS

SEQ ID NO: 1404698 - protein, 9 aa, Homo Sapiens
LLIRVENED

SEQ ID NO: 1404699 - protein, 9 aa, Homo Sapiens
APTLSTAAV

SEQ ID NO: 1404700 - protein, 9 aa, Homo Sapiens
NDPFFMVET

SEQ ID NO: 1404701 - protein, 9 aa, Homo Sapiens
LKQIHLHLT

SEQ ID NO: 1404702 - protein, 9 aa, Homo Sapiens
ASHDTVTFR

SEQ ID NO: 1404703 - protein, 9 aa, Homo Sapiens
SDSSIICLS

SEQ ID NO: 1404704 - protein, 9 aa, Homo Sapiens
ALQGQTGNS

SEQ ID NO: 1404705 - protein, 9 aa, Homo Sapiens
AAGAREAGR

SEQ ID NO: 1404706 - protein, 9 aa, Homo Sapiens
WDLASVTLY

SEQ ID NO: 1404707 - protein, 9 aa, Homo Sapiens
HLVAEVEES

SEQ ID NO: 1404708 - protein, 9 aa, Homo Sapiens
LLQQTAAKA

SEQ ID NO: 1404709 - protein, 9 aa, Homo Sapiens
IRHRKVYTE

SEQ ID NO: 1404710 - protein, 9 aa, Homo Sapiens
GGPSLWALP

SEQ ID NO: 1404711 - protein, 9 aa, Homo Sapiens
NYVEHNLKS

SEQ ID NO: 1404712 - protein, 9 aa, Homo Sapiens
IWERFDNET

SEQ ID NO: 1404713 - protein, 9 aa, Homo Sapiens
VFPRTWLSV

SEQ ID NO: 1404714 - protein, 9 aa, Homo Sapiens
HASGNTFSH

SEQ ID NO: 1404715 - protein, 9 aa, Homo Sapiens
DKDLRVSEK

SEQ ID NO: 1404716 - protein, 9 aa, Homo Sapiens
HLVLLPGVL

SEQ ID NO: 1404717 - protein, 9 aa, Homo Sapiens
LMWMNMNIM

SEQ ID NO: 1404718 - protein, 9 aa, Homo Sapiens
NGTQQVLLD

SEQ ID NO: 1404719 - protein, 9 aa, Homo Sapiens
NKKETEKSD

SEQ ID NO: 1404720 - protein, 9 aa, Homo Sapiens
LVDPQPPQK

SEQ ID NO: 1404721 - protein, 9 aa, Homo Sapiens
MLICRAGAS

SEQ ID NO: 1404722 - protein, 9 aa, Homo Sapiens
VCRRPENNY

SEQ ID NO: 1404723 - protein, 9 aa, Homo Sapiens
RRKQQEERL

SEQ ID NO: 1404724 - protein, 9 aa, Homo Sapiens
PMVVEVHDQ

SEQ ID NO: 1404725 - protein, 9 aa, Homo Sapiens
RGNWGHLDR

SEQ ID NO: 1404726 - protein, 9 aa, Homo Sapiens
DPFFMVETL

SEQ ID NO: 1404727 - protein, 9 aa, Homo Sapiens
PVACKGKAR

SEQ ID NO: 1404728 - protein, 9 aa, Homo Sapiens
KANIPNMDT

SEQ ID NO: 1404729 - protein, 9 aa, Homo Sapiens
AASGKGSAK

SEQ ID NO: 1404730 - protein, 9 aa, Homo Sapiens
EHNLKSLME

SEQ ID NO: 1404731 - protein, 9 aa, Homo Sapiens
SESMWRQCS

SEQ ID NO: 1404732 - protein, 9 aa, Homo Sapiens
KVELESRLV

SEQ ID NO: 1404733 - protein, 9 aa, Homo Sapiens
LPCPIHQVR

SEQ ID NO: 1404734 - protein, 9 aa, Homo Sapiens
GIGLSAETT

SEQ ID NO: 1404735 - protein, 9 aa, Homo Sapiens
VLCTISFRQ

SEQ ID NO: 1404736 - protein, 9 aa, Homo Sapiens
ISARGSSPL

SEQ ID NO: 1404737 - protein, 9 aa, Homo Sapiens
ARLVASKSQ

SEQ ID NO: 1404738 - protein, 9 aa, Homo Sapiens
SSVHLYFCD

SEQ ID NO: 1404739 - protein, 9 aa, Homo Sapiens
EFGGVAPRC

SEQ ID NO: 1404740 - protein, 9 aa, Homo Sapiens
AIVCTGYNA

SEQ ID NO: 1404741 - protein, 9 aa, Homo Sapiens
VKGLWVLCS

SEQ ID NO: 1404742 - protein, 9 aa, Homo Sapiens
EELALQGQT

SEQ ID NO: 1404743 - protein, 9 aa, Homo Sapiens
PSQFERKDE

SEQ ID NO: 1404744 - protein, 9 aa, Homo Sapiens
CLPGLTHPA

SEQ ID NO: 1404745 - protein, 9 aa, Homo Sapiens
HVLKMMFWL

SEQ ID NO: 1404746 - protein, 9 aa, Homo Sapiens
NMDFLTLRH

SEQ ID NO: 1404747 - protein, 9 aa, Homo Sapiens
PWQVMASLT

SEQ ID NO: 1404748 - protein, 9 aa, Homo Sapiens
RRRSTEGLA

SEQ ID NO: 1404749 - protein, 9 aa, Homo Sapiens
FYSLICMYT

SEQ ID NO: 1404750 - protein, 9 aa, Homo Sapiens
CRESERDYN

SEQ ID NO: 1404751 - protein, 9 aa, Homo Sapiens
EHVVGKVCR

SEQ ID NO: 1404752 - protein, 9 aa, Homo Sapiens
FFILVPRLE

SEQ ID NO: 1404753 - protein, 9 aa, Homo Sapiens
PVHLVLLPG

SEQ ID NO: 1404754 - protein, 9 aa, Homo Sapiens
SCVAQVYFF

SEQ ID NO: 1404755 - protein, 9 aa, Homo Sapiens
GAVDPQGEE

SEQ ID NO: 1404756 - protein, 9 aa, Homo Sapiens
ENNLCNQYE

SEQ ID NO: 1404757 - protein, 9 aa, Homo Sapiens
PSLASCASV

SEQ ID NO: 1404758 - protein, 9 aa, Homo Sapiens
EPEPCLWVV

SEQ ID NO: 1404759 - protein, 9 aa, Homo Sapiens
LRITQQKSN

SEQ ID NO: 1404760 - protein, 9 aa, Homo Sapiens
QVHGVINMG

SEQ ID NO: 1404761 - protein, 9 aa, Homo Sapiens
EQVHGVINM

SEQ ID NO: 1404762 - protein, 9 aa, Homo Sapiens
ASAPCGAAG

SEQ ID NO: 1404763 - protein, 9 aa, Homo Sapiens
HSCVAQVYF

SEQ ID NO: 1404764 - protein, 9 aa, Homo Sapiens
GGDRPHISS

SEQ ID NO: 1404765 - protein, 9 aa, Homo Sapiens
LRDSTNFLF

SEQ ID NO: 1404766 - protein, 9 aa, Homo Sapiens
FNRLLHFAH

SEQ ID NO: 1404767 - protein, 9 aa, Homo Sapiens
QSESSLSSG

SEQ ID NO: 1404768 - protein, 9 aa, Homo Sapiens
TLLDEKRVA

SEQ ID NO: 1404769 - protein, 9 aa, Homo Sapiens
DIDFGHMET

SEQ ID NO: 1404770 - protein, 9 aa, Homo Sapiens
QENTEEEEE

SEQ ID NO: 1404771 - protein, 9 aa, Homo Sapiens
SHRLRVLYR

SEQ ID NO: 1404772 - protein, 9 aa, Homo Sapiens
HCGPYETDL

SEQ ID NO: 1404773 - protein, 9 aa, Homo Sapiens
PPILLPALK

SEQ ID NO: 1404774 - protein, 9 aa, Homo Sapiens
IVQKLKKMR

SEQ ID NO: 1404775 - protein, 9 aa, Homo Sapiens
KKQTEGGRR

SEQ ID NO: 1404776 - protein, 9 aa, Homo Sapiens
VDCLQAFWD

SEQ ID NO: 1404777 - protein, 9 aa, Homo Sapiens
RFLSGLVNQ

SEQ ID NO: 1404778 - protein, 9 aa, Homo Sapiens
TEQLKLLHE

SEQ ID NO: 1404779 - protein, 9 aa, Homo Sapiens
CGHAGTHQV

SEQ ID NO: 1404780 - protein, 9 aa, Homo Sapiens
VVRCRETQV

SEQ ID NO: 1404781 - protein, 9 aa, Homo Sapiens
PVACPDDQG

SEQ ID NO: 1404782 - protein, 9 aa, Homo Sapiens
KVIQNIEQQ

SEQ ID NO: 1404783 - protein, 9 aa, Homo Sapiens
ASHSGISLV

SEQ ID NO: 1404784 - protein, 9 aa, Homo Sapiens
PLKHHSHQP

SEQ ID NO: 1404785 - protein, 9 aa, Homo Sapiens
GEPRWARLP

SEQ ID NO: 1404786 - protein, 9 aa, Homo Sapiens
DIHSSGLLS

SEQ ID NO: 1404787 - protein, 9 aa, Homo Sapiens
EQEMVCMVR

SEQ ID NO: 1404788 - protein, 9 aa, Homo Sapiens
LCVQELGLS

SEQ ID NO: 1404789 - protein, 9 aa, Homo Sapiens
LAVKPKKTE

SEQ ID NO: 1404790 - protein, 9 aa, Homo Sapiens
ILDVKDVDP

SEQ ID NO: 1404791 - protein, 9 aa, Homo Sapiens
HHSHALVSL

SEQ ID NO: 1404792 - protein, 9 aa, Homo Sapiens
GKGSAKPSA

SEQ ID NO: 1404793 - protein, 9 aa, Homo Sapiens
YFFQAESKY

SEQ ID NO: 1404794 - protein, 9 aa, Homo Sapiens
LRVSEKYLL

SEQ ID NO: 1404795 - protein, 9 aa, Homo Sapiens
TQATTSTEA

SEQ ID NO: 1404796 - protein, 9 aa, Homo Sapiens
EILRRSSLG

SEQ ID NO: 1404797 - protein, 9 aa, Homo Sapiens
NYHIPSIAG

SEQ ID NO: 1404798 - protein, 9 aa, Homo Sapiens
SCASSGASA

SEQ ID NO: 1404799 - protein, 9 aa, Homo Sapiens
MEDKDAVAF

SEQ ID NO: 1404800 - protein, 9 aa, Homo Sapiens
RMTKPEPAA

SEQ ID NO: 1404801 - protein, 9 aa, Homo Sapiens
VCMVRAATL

SEQ ID NO: 1404802 - protein, 9 aa, Homo Sapiens
ERSSALSTH

SEQ ID NO: 1404803 - protein, 9 aa, Homo Sapiens
SSLLWPAAS

SEQ ID NO: 1404804 - protein, 9 aa, Homo Sapiens
RQMLPTLST

SEQ ID NO: 1404805 - protein, 9 aa, Homo Sapiens
PARSSSALS

SEQ ID NO: 1404806 - protein, 9 aa, Homo Sapiens
TKLAMSFLN

SEQ ID NO: 1404807 - protein, 9 aa, Homo Sapiens
GQGRVVPVH

SEQ ID NO: 1404808 - protein, 9 aa, Homo Sapiens
LNRHEYPLN

SEQ ID NO: 1404809 - protein, 9 aa, Homo Sapiens
FFLHKEFLL

SEQ ID NO: 1404810 - protein, 9 aa, Homo Sapiens
QLWMKIYFQ

SEQ ID NO: 1404811 - protein, 9 aa, Homo Sapiens
APTPTGRGR

SEQ ID NO: 1404812 - protein, 9 aa, Homo Sapiens
YKLVVVGAD

SEQ ID NO: 1404813 - protein, 9 aa, Homo Sapiens
IHAKYDVID

SEQ ID NO: 1404814 - protein, 9 aa, Homo Sapiens
APSAQRAED

SEQ ID NO: 1404815 - protein, 9 aa, Homo Sapiens
LDVFILLHP

SEQ ID NO: 1404816 - protein, 9 aa, Homo Sapiens
ELEKHVERL

SEQ ID NO: 1404817 - protein, 9 aa, Homo Sapiens
EALKQMSLA

SEQ ID NO: 1404818 - protein, 9 aa, Homo Sapiens
VTPLRVQSV

SEQ ID NO: 1404819 - protein, 9 aa, Homo Sapiens
HPGVTIRKH

SEQ ID NO: 1404820 - protein, 9 aa, Homo Sapiens
LGIKELYEW

SEQ ID NO: 1404821 - protein, 9 aa, Homo Sapiens
YLLGSNKSP

SEQ ID NO: 1404822 - protein, 9 aa, Homo Sapiens
SQYYFRIAS

SEQ ID NO: 1404823 - protein, 9 aa, Homo Sapiens
ESVLRDSLP

SEQ ID NO: 1404824 - protein, 9 aa, Homo Sapiens
LLRCPSKKS

SEQ ID NO: 1404825 - protein, 9 aa, Homo Sapiens
HPAHQPLGS

SEQ ID NO: 1404826 - protein, 9 aa, Homo Sapiens
NQYEEKVRP

SEQ ID NO: 1404827 - protein, 9 aa, Homo Sapiens
GRWKEKSKR

SEQ ID NO: 1404828 - protein, 9 aa, Homo Sapiens
NEVNNFPQK

SEQ ID NO: 1404829 - protein, 9 aa, Homo Sapiens
RQWSTSKHW

SEQ ID NO: 1404830 - protein, 9 aa, Homo Sapiens
KSSLLDFML

SEQ ID NO: 1404831 - protein, 9 aa, Homo Sapiens
PRPIRPPFL

SEQ ID NO: 1404832 - protein, 9 aa, Homo Sapiens
KKEDEENKY

SEQ ID NO: 1404833 - protein, 9 aa, Homo Sapiens
MFQATSQIQ

SEQ ID NO: 1404834 - protein, 9 aa, Homo Sapiens
KQNCSHFPT

SEQ ID NO: 1404835 - protein, 9 aa, Homo Sapiens
WRAPPGRWC

SEQ ID NO: 1404836 - protein, 9 aa, Homo Sapiens
DQYWNEDQP

SEQ ID NO: 1404837 - protein, 9 aa, Homo Sapiens
AAMFGGHLW

SEQ ID NO: 1404838 - protein, 9 aa, Homo Sapiens
ALPPPCCDP

SEQ ID NO: 1404839 - protein, 9 aa, Homo Sapiens
LSQQVHKAT

SEQ ID NO: 1404840 - protein, 9 aa, Homo Sapiens
TGSVHAASV

SEQ ID NO: 1404841 - protein, 9 aa, Homo Sapiens
SRSCMTSQP

SEQ ID NO: 1404842 - protein, 9 aa, Homo Sapiens
LPRPSLTIN

SEQ ID NO: 1404843 - protein, 9 aa, Homo Sapiens
QLTAAFFLT

SEQ ID NO: 1404844 - protein, 9 aa, Homo Sapiens
DLVVPAGKG

SEQ ID NO: 1404845 - protein, 9 aa, Homo Sapiens
KLPLTIFAN

SEQ ID NO: 1404846 - protein, 9 aa, Homo Sapiens
HKMASYIYC

SEQ ID NO: 1404847 - protein, 9 aa, Homo Sapiens
VTLLLALPI

SEQ ID NO: 1404848 - protein, 9 aa, Homo Sapiens
SYCRETLQM

SEQ ID NO: 1404849 - protein, 9 aa, Homo Sapiens
EFSECLIAS

SEQ ID NO: 1404850 - protein, 9 aa, Homo Sapiens
PALVAPRGL

SEQ ID NO: 1404851 - protein, 9 aa, Homo Sapiens
RELQPWCFT

SEQ ID NO: 1404852 - protein, 9 aa, Homo Sapiens
VLPTCLLAS

SEQ ID NO: 1404853 - protein, 9 aa, Homo Sapiens
TVIASTDPE

SEQ ID NO: 1404854 - protein, 9 aa, Homo Sapiens
SLPVEGTSP

SEQ ID NO: 1404855 - protein, 9 aa, Homo Sapiens
KARFSTASL

SEQ ID NO: 1404856 - protein, 9 aa, Homo Sapiens
EDLVVPAGK

SEQ ID NO: 1404857 - protein, 9 aa, Homo Sapiens
QGKLLIVKC

SEQ ID NO: 1404858 - protein, 9 aa, Homo Sapiens
ASSSPKIAF

SEQ ID NO: 1404859 - protein, 9 aa, Homo Sapiens
HLLQPASLP

SEQ ID NO: 1404860 - protein, 9 aa, Homo Sapiens
CFTISLAPQ

SEQ ID NO: 1404861 - protein, 9 aa, Homo Sapiens
TLYVEESSW

SEQ ID NO: 1404862 - protein, 9 aa, Homo Sapiens
STKRKNMRP

SEQ ID NO: 1404863 - protein, 9 aa, Homo Sapiens
HQLSDPNHG

SEQ ID NO: 1404864 - protein, 9 aa, Homo Sapiens
LTGATSQHQ

SEQ ID NO: 1404865 - protein, 9 aa, Homo Sapiens
LPSPRPPPL

SEQ ID NO: 1404866 - protein, 9 aa, Homo Sapiens
SSIQIHHYP

SEQ ID NO: 1404867 - protein, 9 aa, Homo Sapiens
SDNAPLTSE

SEQ ID NO: 1404868 - protein, 9 aa, Homo Sapiens
NNIPNKIRV

SEQ ID NO: 1404869 - protein, 9 aa, Homo Sapiens
LSEPNEVNP

SEQ ID NO: 1404870 - protein, 9 aa, Homo Sapiens
PPKIERNFP

SEQ ID NO: 1404871 - protein, 9 aa, Homo Sapiens
SRENPHGTL

SEQ ID NO: 1404872 - protein, 9 aa, Homo Sapiens
LDPTSSSFS

SEQ ID NO: 1404873 - protein, 9 aa, Homo Sapiens
MFGGHLWRA

SEQ ID NO: 1404874 - protein, 9 aa, Homo Sapiens
RQAINDGSP

SEQ ID NO: 1404875 - protein, 9 aa, Homo Sapiens
TNRKALSFN

SEQ ID NO: 1404876 - protein, 9 aa, Homo Sapiens
HFKKHLQDV

SEQ ID NO: 1404877 - protein, 9 aa, Homo Sapiens
LTTMCEDFS

SEQ ID NO: 1404878 - protein, 9 aa, Homo Sapiens
QFTGLMQLM

SEQ ID NO: 1404879 - protein, 9 aa, Homo Sapiens
ISRPTSRAR

SEQ ID NO: 1404880 - protein, 9 aa, Homo Sapiens
ALKISMPEV

SEQ ID NO: 1404881 - protein, 9 aa, Homo Sapiens
NNFPQKISY

SEQ ID NO: 1404882 - protein, 9 aa, Homo Sapiens
IYMADNVNY

SEQ ID NO: 1404883 - protein, 9 aa, Homo Sapiens
IHTSNKPYE

SEQ ID NO: 1404884 - protein, 9 aa, Homo Sapiens
KKARFSTAS

SEQ ID NO: 1404885 - protein, 9 aa, Homo Sapiens
SVERRWEKD

SEQ ID NO: 1404886 - protein, 9 aa, Homo Sapiens
LAGGSANTV

SEQ ID NO: 1404887 - protein, 9 aa, Homo Sapiens
LLVSLLLKE

SEQ ID NO: 1404888 - protein, 9 aa, Homo Sapiens
RIAKGASMT

SEQ ID NO: 1404889 - protein, 9 aa, Homo Sapiens
GCCSDMATT

SEQ ID NO: 1404890 - protein, 9 aa, Homo Sapiens
WTWINRFVI

SEQ ID NO: 1404891 - protein, 9 aa, Homo Sapiens
DHGKSHVFN

SEQ ID NO: 1404892 - protein, 9 aa, Homo Sapiens
FGEIPGRII

SEQ ID NO: 1404893 - protein, 9 aa, Homo Sapiens
LFLPSAAQK

SEQ ID NO: 1404894 - protein, 9 aa, Homo Sapiens
PTCLLASWQ

SEQ ID NO: 1404895 - protein, 9 aa, Homo Sapiens
LKLCIYFLE

SEQ ID NO: 1404896 - protein, 9 aa, Homo Sapiens
EGCCSDMAT

SEQ ID NO: 1404897 - protein, 9 aa, Homo Sapiens
RDVILTHNG

SEQ ID NO: 1404898 - protein, 9 aa, Homo Sapiens
HIHLGTYGV

SEQ ID NO: 1404899 - protein, 9 aa, Homo Sapiens
KNTRAQSGE

SEQ ID NO: 1404900 - protein, 9 aa, Homo Sapiens
YDITVLCTF

SEQ ID NO: 1404901 - protein, 9 aa, Homo Sapiens
HPIYEPKDC

SEQ ID NO: 1404902 - protein, 9 aa, Homo Sapiens
NIRVEEGMY

SEQ ID NO: 1404903 - protein, 9 aa, Homo Sapiens
QTPQPHLCR

SEQ ID NO: 1404904 - protein, 9 aa, Homo Sapiens
GMSRTPPRR

SEQ ID NO: 1404905 - protein, 9 aa, Homo Sapiens
SASTQKRYI

SEQ ID NO: 1404906 - protein, 9 aa, Homo Sapiens
PRPCSSPSP

SEQ ID NO: 1404907 - protein, 9 aa, Homo Sapiens
PPALVAPRG

SEQ ID NO: 1404908 - protein, 9 aa, Homo Sapiens
EENKYLDVI

SEQ ID NO: 1404909 - protein, 9 aa, Homo Sapiens
DKTKNFLFG

SEQ ID NO: 1404910 - protein, 9 aa, Homo Sapiens
FGRCISQTE

SEQ ID NO: 1404911 - protein, 9 aa, Homo Sapiens
ENFYSDLNS

SEQ ID NO: 1404912 - protein, 9 aa, Homo Sapiens
QSCSQVGGV

SEQ ID NO: 1404913 - protein, 9 aa, Homo Sapiens
SRPKRKYKP

SEQ ID NO: 1404914 - protein, 9 aa, Homo Sapiens
NKIRVRNGN

SEQ ID NO: 1404915 - protein, 9 aa, Homo Sapiens
ACGPCWNTS

SEQ ID NO: 1404916 - protein, 9 aa, Homo Sapiens
QEHNLDNYL

SEQ ID NO: 1404917 - protein, 9 aa, Homo Sapiens
CTVWDPIAA

SEQ ID NO: 1404918 - protein, 9 aa, Homo Sapiens
AGKFGRCIS

SEQ ID NO: 1404919 - protein, 9 aa, Homo Sapiens
KSQGALEEY

SEQ ID NO: 1404920 - protein, 9 aa, Homo Sapiens
VLQVGDLQA

SEQ ID NO: 1404921 - protein, 9 aa, Homo Sapiens
TSEPTPRGM

SEQ ID NO: 1404922 - protein, 9 aa, Homo Sapiens
VGHHHRPRP

SEQ ID NO: 1404923 - protein, 9 aa, Homo Sapiens
EKSQGALEE

SEQ ID NO: 1404924 - protein, 9 aa, Homo Sapiens
AGTIVEAHL

SEQ ID NO: 1404925 - protein, 9 aa, Homo Sapiens
SCRIQKSDF

SEQ ID NO: 1404926 - protein, 9 aa, Homo Sapiens
GMPYHQSAP

SEQ ID NO: 1404927 - protein, 9 aa, Homo Sapiens
SLPGPCASL

SEQ ID NO: 1404928 - protein, 9 aa, Homo Sapiens
HDTSIGNPI

SEQ ID NO: 1404929 - protein, 9 aa, Homo Sapiens
ESYTLNADK

SEQ ID NO: 1404930 - protein, 9 aa, Homo Sapiens
KFGRCISQT

SEQ ID NO: 1404931 - protein, 9 aa, Homo Sapiens
TPACSPPAP

SEQ ID NO: 1404932 - protein, 9 aa, Homo Sapiens
LLSTRSLGS

SEQ ID NO: 1404933 - protein, 9 aa, Homo Sapiens
FTKSPQTVS

SEQ ID NO: 1404934 - protein, 9 aa, Homo Sapiens
ESERNNPDV

SEQ ID NO: 1404935 - protein, 9 aa, Homo Sapiens
LLIVKCPHI

SEQ ID NO: 1404936 - protein, 9 aa, Homo Sapiens
LLEDIKRFA

SEQ ID NO: 1404937 - protein, 9 aa, Homo Sapiens
LMTKNPLAM

SEQ ID NO: 1404938 - protein, 9 aa, Homo Sapiens
FLKTWFRSN

SEQ ID NO: 1404939 - protein, 9 aa, Homo Sapiens
CSRHYRAPE

SEQ ID NO: 1404940 - protein, 9 aa, Homo Sapiens
QVGDLQAVG

SEQ ID NO: 1404941 - protein, 9 aa, Homo Sapiens
DPTEWRFQG

SEQ ID NO: 1404942 - protein, 9 aa, Homo Sapiens
NTSKDLKVK

SEQ ID NO: 1404943 - protein, 9 aa, Homo Sapiens
SYPVVNRIN

SEQ ID NO: 1404944 - protein, 9 aa, Homo Sapiens
RPKNAFMVW

SEQ ID NO: 1404945 - protein, 9 aa, Homo Sapiens
ERNFPPYNG

SEQ ID NO: 1404946 - protein, 9 aa, Homo Sapiens
KGICQRDVI

SEQ ID NO: 1404947 - protein, 9 aa, Homo Sapiens
TNLKTLNQY

SEQ ID NO: 1404948 - protein, 9 aa, Homo Sapiens
VVHVTVFDL

SEQ ID NO: 1404949 - protein, 9 aa, Homo Sapiens
PPAEATALS

SEQ ID NO: 1404950 - protein, 9 aa, Homo Sapiens
YDNPDFNYT

SEQ ID NO: 1404951 - protein, 9 aa, Homo Sapiens
WPSTSRSCM

SEQ ID NO: 1404952 - protein, 9 aa, Homo Sapiens
YLITTGIRK

SEQ ID NO: 1404953 - protein, 9 aa, Homo Sapiens
EDTKTLEGP

SEQ ID NO: 1404954 - protein, 9 aa, Homo Sapiens
GALPPPCCD

SEQ ID NO: 1404955 - protein, 9 aa, Homo Sapiens
VKSQCTTLY

SEQ ID NO: 1404956 - protein, 9 aa, Homo Sapiens
VGVADLGRL

SEQ ID NO: 1404957 - protein, 9 aa, Homo Sapiens
NIPNKIRVR

SEQ ID NO: 1404958 - protein, 9 aa, Homo Sapiens
NNWNSSTQW

SEQ ID NO: 1404959 - protein, 9 aa, Homo Sapiens
NMRPVDMSK

SEQ ID NO: 1404960 - protein, 9 aa, Homo Sapiens
ADNVNYFIL

SEQ ID NO: 1404961 - protein, 9 aa, Homo Sapiens
WGPSWRMRR

SEQ ID NO: 1404962 - protein, 9 aa, Homo Sapiens
EKLPLTIFA

SEQ ID NO: 1404963 - protein, 9 aa, Homo Sapiens
AAEKIYISL

SEQ ID NO: 1404964 - protein, 9 aa, Homo Sapiens
SLAAACSVT

SEQ ID NO: 1404965 - protein, 9 aa, Homo Sapiens
RACFCALLN

SEQ ID NO: 1404966 - protein, 9 aa, Homo Sapiens
NLVPLFCEF

SEQ ID NO: 1404967 - protein, 9 aa, Homo Sapiens
CFSIVADHG

SEQ ID NO: 1404968 - protein, 9 aa, Homo Sapiens
LSVAPEFRC

SEQ ID NO: 1404969 - protein, 9 aa, Homo Sapiens
EDVTGAVVL

SEQ ID NO: 1404970 - protein, 9 aa, Homo Sapiens
IAVALLADL

SEQ ID NO: 1404971 - protein, 9 aa, Homo Sapiens
LKERFVRKK

SEQ ID NO: 1404972 - protein, 9 aa, Homo Sapiens
GNLLVSASR

SEQ ID NO: 1404973 - protein, 9 aa, Homo Sapiens
QKRYIFTNT

SEQ ID NO: 1404974 - protein, 9 aa, Homo Sapiens
DVLASLKIP

SEQ ID NO: 1404975 - protein, 9 aa, Homo Sapiens
YETDIKWIK

SEQ ID NO: 1404976 - protein, 9 aa, Homo Sapiens
PPLILWPQA

SEQ ID NO: 1404977 - protein, 9 aa, Homo Sapiens
WMAAPKNRH

SEQ ID NO: 1404978 - protein, 9 aa, Homo Sapiens
GGVQVLDLH

SEQ ID NO: 1404979 - protein, 9 aa, Homo Sapiens
VPFWKESIK

SEQ ID NO: 1404980 - protein, 9 aa, Homo Sapiens
FHVDVEVND

SEQ ID NO: 1404981 - protein, 9 aa, Homo Sapiens
KAHFLKTWF

SEQ ID NO: 1404982 - protein, 9 aa, Homo Sapiens
YSPQDTEII

SEQ ID NO: 1404983 - protein, 9 aa, Homo Sapiens
VHSPWPHKM

SEQ ID NO: 1404984 - protein, 9 aa, Homo Sapiens
NSLIIFTIR

SEQ ID NO: 1404985 - protein, 9 aa, Homo Sapiens
NRQWSTSKH

SEQ ID NO: 1404986 - protein, 9 aa, Homo Sapiens
TISRGCCRM

SEQ ID NO: 1404987 - protein, 9 aa, Homo Sapiens
EMAHIQQNA

SEQ ID NO: 1404988 - protein, 9 aa, Homo Sapiens
GQKQLYNEL

SEQ ID NO: 1404989 - protein, 9 aa, Homo Sapiens
PWPSTSRSC

SEQ ID NO: 1404990 - protein, 9 aa, Homo Sapiens
SLLLKEKQD

SEQ ID NO: 1404991 - protein, 9 aa, Homo Sapiens
IFTKSPQTV

SEQ ID NO: 1404992 - protein, 9 aa, Homo Sapiens
TVEWSARSE

SEQ ID NO: 1404993 - protein, 9 aa, Homo Sapiens
AQKMKKAHF

SEQ ID NO: 1404994 - protein, 9 aa, Homo Sapiens
GRLEGGVQV

SEQ ID NO: 1404995 - protein, 9 aa, Homo Sapiens
ELAGNTSKD

SEQ ID NO: 1404996 - protein, 9 aa, Homo Sapiens
SSSQVEEGP

SEQ ID NO: 1404997 - protein, 9 aa, Homo Sapiens
DEDDGDEEE

SEQ ID NO: 1404998 - protein, 9 aa, Homo Sapiens
LAPPALVAP

SEQ ID NO: 1404999 - protein, 9 aa, Homo Sapiens
KKNNIPNKI

SEQ ID NO: 1405000 - protein, 9 aa, Homo Sapiens
KVNTHIFRH

SEQ ID NO: 1405001 - protein, 9 aa, Homo Sapiens
PLTVEWSAR

SEQ ID NO: 1405002 - protein, 9 aa, Homo Sapiens
STSYNDSAR

SEQ ID NO: 1405003 - protein, 9 aa, Homo Sapiens
LPPPCCDPS

SEQ ID NO: 1405004 - protein, 9 aa, Homo Sapiens
KISENFYSD

SEQ ID NO: 1405005 - protein, 9 aa, Homo Sapiens
YTCNQYGKS

SEQ ID NO: 1405006 - protein, 9 aa, Homo Sapiens
DALGDVAGV

SEQ ID NO: 1405007 - protein, 9 aa, Homo Sapiens
NNSYCRETL

SEQ ID NO: 1405008 - protein, 9 aa, Homo Sapiens
YKKDTATWK

SEQ ID NO: 1405009 - protein, 9 aa, Homo Sapiens
HSDTPTTHL

SEQ ID NO: 1405010 - protein, 9 aa, Homo Sapiens
IRPPFLESK

SEQ ID NO: 1405011 - protein, 9 aa, Homo Sapiens
SARRKRIPF

SEQ ID NO: 1405012 - protein, 9 aa, Homo Sapiens
DEKERRIKN

SEQ ID NO: 1405013 - protein, 9 aa, Homo Sapiens
GWIFKHKTD

SEQ ID NO: 1405014 - protein, 9 aa, Homo Sapiens
HLVKPRVLH

SEQ ID NO: 1405015 - protein, 9 aa, Homo Sapiens
MWFMNEKST

SEQ ID NO: 1405016 - protein, 9 aa, Homo Sapiens
NSSGETLET

SEQ ID NO: 1405017 - protein, 9 aa, Homo Sapiens
LGDVAGVPY

SEQ ID NO: 1405018 - protein, 9 aa, Homo Sapiens
PGQSTGPGW

SEQ ID NO: 1405019 - protein, 9 aa, Homo Sapiens
SAPHILTGA

SEQ ID NO: 1405020 - protein, 9 aa, Homo Sapiens
PQPNKSAVI

SEQ ID NO: 1405021 - protein, 9 aa, Homo Sapiens
DGYICLKTY

SEQ ID NO: 1405022 - protein, 9 aa, Homo Sapiens
IVGLRLLRV

SEQ ID NO: 1405023 - protein, 9 aa, Homo Sapiens
SSSFSKWCR

SEQ ID NO: 1405024 - protein, 9 aa, Homo Sapiens
WQNQMLSAL

SEQ ID NO: 1405025 - protein, 9 aa, Homo Sapiens
RTKRGWMLN

SEQ ID NO: 1405026 - protein, 9 aa, Homo Sapiens
VYTLTIVGN

SEQ ID NO: 1405027 - protein, 9 aa, Homo Sapiens
HLKELACPM

SEQ ID NO: 1405028 - protein, 9 aa, Homo Sapiens
AEKIYISLS

SEQ ID NO: 1405029 - protein, 9 aa, Homo Sapiens
GFGTKVPAL

SEQ ID NO: 1405030 - protein, 9 aa, Homo Sapiens
KELTHPLLV

SEQ ID NO: 1405031 - protein, 9 aa, Homo Sapiens
PQIAYSATN

SEQ ID NO: 1405032 - protein, 9 aa, Homo Sapiens
TINTDLSRI

SEQ ID NO: 1405033 - protein, 9 aa, Homo Sapiens
RATICAKRK

SEQ ID NO: 1405034 - protein, 9 aa, Homo Sapiens
SEDRRETGL

SEQ ID NO: 1405035 - protein, 9 aa, Homo Sapiens
IILAIRIDS

SEQ ID NO: 1405036 - protein, 9 aa, Homo Sapiens
SQQVHKATA

SEQ ID NO: 1405037 - protein, 9 aa, Homo Sapiens
QSGQPCSRQ

SEQ ID NO: 1405038 - protein, 9 aa, Homo Sapiens
TTICRFETL

SEQ ID NO: 1405039 - protein, 9 aa, Homo Sapiens
VEAHLKELA

SEQ ID NO: 1405040 - protein, 9 aa, Homo Sapiens
PYHQSAPHI

SEQ ID NO: 1405041 - protein, 9 aa, Homo Sapiens
RMWFMNEKS

SEQ ID NO: 1405042 - protein, 9 aa, Homo Sapiens
GPGMIFSRV

SEQ ID NO: 1405043 - protein, 9 aa, Homo Sapiens
PQLKQEFSE

SEQ ID NO: 1405044 - protein, 9 aa, Homo Sapiens
TASTHRPNI

SEQ ID NO: 1405045 - protein, 9 aa, Homo Sapiens
RPGTPPPLI

SEQ ID NO: 1405046 - protein, 9 aa, Homo Sapiens
ICAKCGKAF

SEQ ID NO: 1405047 - protein, 9 aa, Homo Sapiens
TQMVAFDQA

SEQ ID NO: 1405048 - protein, 9 aa, Homo Sapiens
SQVEEGPST

SEQ ID NO: 1405049 - protein, 9 aa, Homo Sapiens
FVNLVPLFC

SEQ ID NO: 1405050 - protein, 9 aa, Homo Sapiens
RGEAKKRRK

SEQ ID NO: 1405051 - protein, 9 aa, Homo Sapiens
TGATSQHQP

SEQ ID NO: 1405052 - protein, 9 aa, Homo Sapiens
SATNIDLSD

SEQ ID NO: 1405053 - protein, 9 aa, Homo Sapiens
LLADLGFLS

SEQ ID NO: 1405054 - protein, 9 aa, Homo Sapiens
IRKVCLLST

SEQ ID NO: 1405055 - protein, 9 aa, Homo Sapiens
EKERRIKNP

SEQ ID NO: 1405056 - protein, 9 aa, Homo Sapiens
GLFLPSAAQ

SEQ ID NO: 1405057 - protein, 9 aa, Homo Sapiens
IISMFYGVI

SEQ ID NO: 1405058 - protein, 9 aa, Homo Sapiens
THLASKESC

SEQ ID NO: 1405059 - protein, 9 aa, Homo Sapiens
RNNPDVSYE

SEQ ID NO: 1405060 - protein, 9 aa, Homo Sapiens
GAAIDTVED

SEQ ID NO: 1405061 - protein, 9 aa, Homo Sapiens
LIILAIRID

SEQ ID NO: 1405062 - protein, 9 aa, Homo Sapiens
QTLNFHFWT

SEQ ID NO: 1405063 - protein, 9 aa, Homo Sapiens
GGGAGVLPD

SEQ ID NO: 1405064 - protein, 9 aa, Homo Sapiens
RHYRAPELI

SEQ ID NO: 1405065 - protein, 9 aa, Homo Sapiens
THHVVILFV

SEQ ID NO: 1405066 - protein, 9 aa, Homo Sapiens
VTYSALWSS

SEQ ID NO: 1405067 - protein, 9 aa, Homo Sapiens
QMENTNNYH

SEQ ID NO: 1405068 - protein, 9 aa, Homo Sapiens
ARMLLEDIK

SEQ ID NO: 1405069 - protein, 9 aa, Homo Sapiens
MLIFPVTVI

SEQ ID NO: 1405070 - protein, 9 aa, Homo Sapiens
PPGRWCFPT

SEQ ID NO: 1405071 - protein, 9 aa, Homo Sapiens
DLGRLEGGV

SEQ ID NO: 1405072 - protein, 9 aa, Homo Sapiens
KKRVFDLEW

SEQ ID NO: 1405073 - protein, 9 aa, Homo Sapiens
LDKTKNFLF

SEQ ID NO: 1405074 - protein, 9 aa, Homo Sapiens
ETDIKWIKK

SEQ ID NO: 1405075 - protein, 9 aa, Homo Sapiens
SASQIWNLN

SEQ ID NO: 1405076 - protein, 9 aa, Homo Sapiens
SPRACAPKE

SEQ ID NO: 1405077 - protein, 9 aa, Homo Sapiens
LSFSGPREP

SEQ ID NO: 1405078 - protein, 9 aa, Homo Sapiens
KKISENFYS

SEQ ID NO: 1405079 - protein, 9 aa, Homo Sapiens
MLHSCRIQK

SEQ ID NO: 1405080 - protein, 9 aa, Homo Sapiens
IPSIHPIYE

SEQ ID NO: 1405081 - protein, 9 aa, Homo Sapiens
MENTNNYHN

SEQ ID NO: 1405082 - protein, 9 aa, Homo Sapiens
ESFAQKNIL

SEQ ID NO: 1405083 - protein, 9 aa, Homo Sapiens
KGSVERRWE

SEQ ID NO: 1405084 - protein, 9 aa, Homo Sapiens
NWNSSTQWG

SEQ ID NO: 1405085 - protein, 9 aa, Homo Sapiens
ASWQPGGCR

SEQ ID NO: 1405086 - protein, 9 aa, Homo Sapiens
SGLCPLMLS

SEQ ID NO: 1405087 - protein, 9 aa, Homo Sapiens
QRQILHLGL

SEQ ID NO: 1405088 - protein, 9 aa, Homo Sapiens
GSVHAASVA

SEQ ID NO: 1405089 - protein, 9 aa, Homo Sapiens
HMKQGVLTH

SEQ ID NO: 1405090 - protein, 9 aa, Homo Sapiens
MAHIQQNAV

SEQ ID NO: 1405091 - protein, 9 aa, Homo Sapiens
TGLMQLMWL

SEQ ID NO: 1405092 - protein, 9 aa, Homo Sapiens
SYRCSRMRS

SEQ ID NO: 1405093 - protein, 9 aa, Homo Sapiens
LDEFLMGGM

SEQ ID NO: 1405094 - protein, 9 aa, Homo Sapiens
FLTTLLIGL

SEQ ID NO: 1405095 - protein, 9 aa, Homo Sapiens
FLMGGMSRT

SEQ ID NO: 1405096 - protein, 9 aa, Homo Sapiens
SECGWIFKH

SEQ ID NO: 1405097 - protein, 9 aa, Homo Sapiens
SREAGPVQS

SEQ ID NO: 1405098 - protein, 9 aa, Homo Sapiens
TSMYQNSSI

SEQ ID NO: 1405099 - protein, 9 aa, Homo Sapiens
RMLLEDIKR

SEQ ID NO: 1405100 - protein, 9 aa, Homo Sapiens
CKESFAQKN

SEQ ID NO: 1405101 - protein, 9 aa, Homo Sapiens
IILPGNSLI

SEQ ID NO: 1405102 - protein, 9 aa, Homo Sapiens
RKYKPKPRE

SEQ ID NO: 1405103 - protein, 9 aa, Homo Sapiens
VLFCESCNT

SEQ ID NO: 1405104 - protein, 9 aa, Homo Sapiens
RIGGGTPLS

SEQ ID NO: 1405105 - protein, 9 aa, Homo Sapiens
PTSEPTPRG

SEQ ID NO: 1405106 - protein, 9 aa, Homo Sapiens
ARDPEWWLQ

SEQ ID NO: 1405107 - protein, 9 aa, Homo Sapiens
EDDTPRRGW

SEQ ID NO: 1405108 - protein, 9 aa, Homo Sapiens
QFAYEDTKT

SEQ ID NO: 1405109 - protein, 9 aa, Homo Sapiens
AAVPDLRHI

SEQ ID NO: 1405110 - protein, 9 aa, Homo Sapiens
QRQQWEARK

SEQ ID NO: 1405111 - protein, 9 aa, Homo Sapiens
PSPRPPPLV

SEQ ID NO: 1405112 - protein, 9 aa, Homo Sapiens
VADSLAVAK

SEQ ID NO: 1405113 - protein, 9 aa, Homo Sapiens
GDVAGVPYS

SEQ ID NO: 1405114 - protein, 9 aa, Homo Sapiens
LVYETDIKW

SEQ ID NO: 1405115 - protein, 9 aa, Homo Sapiens
LLQDIVVSG

SEQ ID NO: 1405116 - protein, 9 aa, Homo Sapiens
HAASVAASR

SEQ ID NO: 1405117 - protein, 9 aa, Homo Sapiens
AQKTARCPG

SEQ ID NO: 1405118 - protein, 9 aa, Homo Sapiens
NVPKKNSRK

SEQ ID NO: 1405119 - protein, 9 aa, Homo Sapiens
STPACSPPA

SEQ ID NO: 1405120 - protein, 9 aa, Homo Sapiens
FGEAAEKIY

SEQ ID NO: 1405121 - protein, 9 aa, Homo Sapiens
FCRMWFMNE

SEQ ID NO: 1405122 - protein, 9 aa, Homo Sapiens
CLSLENRGI

SEQ ID NO: 1405123 - protein, 9 aa, Homo Sapiens
GLFHDTSIG

SEQ ID NO: 1405124 - protein, 9 aa, Homo Sapiens
LLGIISVEI

SEQ ID NO: 1405125 - protein, 9 aa, Homo Sapiens
SPELHQKSP

SEQ ID NO: 1405126 - protein, 9 aa, Homo Sapiens
TAATLRCPA

SEQ ID NO: 1405127 - protein, 9 aa, Homo Sapiens
HDPPPMDQY

SEQ ID NO: 1405128 - protein, 9 aa, Homo Sapiens
GHIKRPKNA

SEQ ID NO: 1405129 - protein, 9 aa, Homo Sapiens
NPLAMYPNL

SEQ ID NO: 1405130 - protein, 9 aa, Homo Sapiens
HFLKTWFRS

SEQ ID NO: 1405131 - protein, 9 aa, Homo Sapiens
RWCFPTQAR

SEQ ID NO: 1405132 - protein, 9 aa, Homo Sapiens
FLDVDSSPK

SEQ ID NO: 1405133 - protein, 9 aa, Homo Sapiens
AKCGKAFTD

SEQ ID NO: 1405134 - protein, 9 aa, Homo Sapiens
EQMLHSCRI

SEQ ID NO: 1405135 - protein, 9 aa, Homo Sapiens
ACSPPAPTW

SEQ ID NO: 1405136 - protein, 9 aa, Homo Sapiens
QCSVAWGPS

SEQ ID NO: 1405137 - protein, 9 aa, Homo Sapiens
CESCNTLTC

SEQ ID NO: 1405138 - protein, 9 aa, Homo Sapiens
FRSNPTKTK

SEQ ID NO: 1405139 - protein, 9 aa, Homo Sapiens
SQIWNLNPV

SEQ ID NO: 1405140 - protein, 9 aa, Homo Sapiens
KQNNSYCRE

SEQ ID NO: 1405141 - protein, 9 aa, Homo Sapiens
DTNITTPKR

SEQ ID NO: 1405142 - protein, 9 aa, Homo Sapiens
PLLQDGGSD

SEQ ID NO: 1405143 - protein, 9 aa, Homo Sapiens
ELHPRYLPV

SEQ ID NO: 1405144 - protein, 9 aa, Homo Sapiens
MSHGQECYR

SEQ ID NO: 1405145 - protein, 9 aa, Homo Sapiens
VQVLDLHHG

SEQ ID NO: 1405146 - protein, 9 aa, Homo Sapiens
AMFQATSQI

SEQ ID NO: 1405147 - protein, 9 aa, Homo Sapiens
HFRWENNFL

SEQ ID NO: 1405148 - protein, 9 aa, Homo Sapiens
VYIEVEDVS

SEQ ID NO: 1405149 - protein, 9 aa, Homo Sapiens
HKLLVTPPR

SEQ ID NO: 1405150 - protein, 9 aa, Homo Sapiens
YMADNVNYF

SEQ ID NO: 1405151 - protein, 9 aa, Homo Sapiens
VFDINLKER

SEQ ID NO: 1405152 - protein, 9 aa, Homo Sapiens
CPALHLVKP

SEQ ID NO: 1405153 - protein, 9 aa, Homo Sapiens
MTSQPEMPT

SEQ ID NO: 1405154 - protein, 9 aa, Homo Sapiens
LIGINTSVL

SEQ ID NO: 1405155 - protein, 9 aa, Homo Sapiens
TWTMATLYC

SEQ ID NO: 1405156 - protein, 9 aa, Homo Sapiens
ATIATDTAA

SEQ ID NO: 1405157 - protein, 9 aa, Homo Sapiens
PTSYRCSRM

SEQ ID NO: 1405158 - protein, 9 aa, Homo Sapiens
LYSVPFWKE

SEQ ID NO: 1405159 - protein, 9 aa, Homo Sapiens
SSTDHQTPQ

SEQ ID NO: 1405160 - protein, 9 aa, Homo Sapiens
QLKQEFSEC

SEQ ID NO: 1405161 - protein, 9 aa, Homo Sapiens
HRPRPIRPP

SEQ ID NO: 1405162 - protein, 9 aa, Homo Sapiens
GDFLDSVNR

SEQ ID NO: 1405163 - protein, 9 aa, Homo Sapiens
YPVVNRINE

SEQ ID NO: 1405164 - protein, 9 aa, Homo Sapiens
LQAKSTYLH

SEQ ID NO: 1405165 - protein, 9 aa, Homo Sapiens
MTEVVRRCR

SEQ ID NO: 1405166 - protein, 9 aa, Homo Sapiens
KRKLYQFLH

SEQ ID NO: 1405167 - protein, 9 aa, Homo Sapiens
ACSGVISAR

SEQ ID NO: 1405168 - protein, 9 aa, Homo Sapiens
TSSSFSKWC

SEQ ID NO: 1405169 - protein, 9 aa, Homo Sapiens
SSWTMTFEE

SEQ ID NO: 1405170 - protein, 9 aa, Homo Sapiens
WDPIAAGGG

SEQ ID NO: 1405171 - protein, 9 aa, Homo Sapiens
HASRENPHG

SEQ ID NO: 1405172 - protein, 9 aa, Homo Sapiens
ANLKFANSY

SEQ ID NO: 1405173 - protein, 9 aa, Homo Sapiens
KKYAKAVTR

SEQ ID NO: 1405174 - protein, 9 aa, Homo Sapiens
FGGHLWRAP

SEQ ID NO: 1405175 - protein, 9 aa, Homo Sapiens
VNNFPQKIS

SEQ ID NO: 1405176 - protein, 9 aa, Homo Sapiens
EEDQSALYV

SEQ ID NO: 1405177 - protein, 9 aa, Homo Sapiens
EHNLDNYLF

SEQ ID NO: 1405178 - protein, 9 aa, Homo Sapiens
FSHASEDIH

SEQ ID NO: 1405179 - protein, 9 aa, Homo Sapiens
MATIATDTA

SEQ ID NO: 1405180 - protein, 9 aa, Homo Sapiens
LMITHHVVI

SEQ ID NO: 1405181 - protein, 9 aa, Homo Sapiens
RKGKSSLLD

SEQ ID NO: 1405182 - protein, 9 aa, Homo Sapiens
MAKLGKVSL

SEQ ID NO: 1405183 - protein, 9 aa, Homo Sapiens
YAKAVTRAK

SEQ ID NO: 1405184 - protein, 9 aa, Homo Sapiens
GARDPEWWL

SEQ ID NO: 1405185 - protein, 9 aa, Homo Sapiens
FLDSVNRRI

SEQ ID NO: 1405186 - protein, 9 aa, Homo Sapiens
KPRVLHQNL

SEQ ID NO: 1405187 - protein, 9 aa, Homo Sapiens
SYTLNADKK

SEQ ID NO: 1405188 - protein, 9 aa, Homo Sapiens
PEPPKIRMY

SEQ ID NO: 1405189 - protein, 9 aa, Homo Sapiens
LVKPRVLHQ

SEQ ID NO: 1405190 - protein, 9 aa, Homo Sapiens
EWQNQMLSA

SEQ ID NO: 1405191 - protein, 9 aa, Homo Sapiens
SIHPIYEPK

SEQ ID NO: 1405192 - protein, 9 aa, Homo Sapiens
ICTNRKALS

SEQ ID NO: 1405193 - protein, 9 aa, Homo Sapiens
GAFRKGKSS

SEQ ID NO: 1405194 - protein, 9 aa, Homo Sapiens
RSFKVNTHI

SEQ ID NO: 1405195 - protein, 9 aa, Homo Sapiens
QECYRGNGK

SEQ ID NO: 1405196 - protein, 9 aa, Homo Sapiens
RNGNRQWST

SEQ ID NO: 1405197 - protein, 9 aa, Homo Sapiens
SALANLKFA

SEQ ID NO: 1405198 - protein, 9 aa, Homo Sapiens
CNTLTCRDC

SEQ ID NO: 1405199 - protein, 9 aa, Homo Sapiens
EEGMYLLIT

SEQ ID NO: 1405200 - protein, 9 aa, Homo Sapiens
NNYHNLYVK

SEQ ID NO: 1405201 - protein, 9 aa, Homo Sapiens
DPGYEFQGE

SEQ ID NO: 1405202 - protein, 9 aa, Homo Sapiens
ENKYLDVIS

SEQ ID NO: 1405203 - protein, 9 aa, Homo Sapiens
EIQYKKDTA

SEQ ID NO: 1405204 - protein, 9 aa, Homo Sapiens
NQYGKSFVH

SEQ ID NO: 1405205 - protein, 9 aa, Homo Sapiens
CLKTYDNPD

SEQ ID NO: 1405206 - protein, 9 aa, Homo Sapiens
STDHQTPQP

SEQ ID NO: 1405207 - protein, 9 aa, Homo Sapiens
GEIISKKTP

SEQ ID NO: 1405208 - protein, 9 aa, Homo Sapiens
SHFPTPLLA

SEQ ID NO: 1405209 - protein, 9 aa, Homo Sapiens
HHTAVLKPE

SEQ ID NO: 1405210 - protein, 9 aa, Homo Sapiens
SSECIEPVH

SEQ ID NO: 1405211 - protein, 9 aa, Homo Sapiens
RCLGLAAKL

SEQ ID NO: 1405212 - protein, 9 aa, Homo Sapiens
TLQLSFKNM

SEQ ID NO: 1405213 - protein, 9 aa, Homo Sapiens
MPGTACGMA

SEQ ID NO: 1405214 - protein, 9 aa, Homo Sapiens
KRPKNAFMV

SEQ ID NO: 1405215 - protein, 9 aa, Homo Sapiens
KTQFLMAMF

SEQ ID NO: 1405216 - protein, 9 aa, Homo Sapiens
RPQPNKSAV

SEQ ID NO: 1405217 - protein, 9 aa, Homo Sapiens
LVLFCESCN

SEQ ID NO: 1405218 - protein, 9 aa, Homo Sapiens
LHLKALKIS

SEQ ID NO: 1405219 - protein, 9 aa, Homo Sapiens
KKNSRKLRG

SEQ ID NO: 1405220 - protein, 9 aa, Homo Sapiens
SIVADHGKS

SEQ ID NO: 1405221 - protein, 9 aa, Homo Sapiens
ASEDRRETG

SEQ ID NO: 1405222 - protein, 9 aa, Homo Sapiens
FKVNTHIFR

SEQ ID NO: 1405223 - protein, 9 aa, Homo Sapiens
SKISFFVMF

SEQ ID NO: 1405224 - protein, 9 aa, Homo Sapiens
CTVCKESFA

SEQ ID NO: 1405225 - protein, 9 aa, Homo Sapiens
FMAVTSSCS

SEQ ID NO: 1405226 - protein, 9 aa, Homo Sapiens
PGAAVHSPW

SEQ ID NO: 1405227 - protein, 9 aa, Homo Sapiens
PTVTSTIHL

SEQ ID NO: 1405228 - protein, 9 aa, Homo Sapiens
HHGLGLLGI

SEQ ID NO: 1405229 - protein, 9 aa, Homo Sapiens
VSTNLKTLN

SEQ ID NO: 1405230 - protein, 9 aa, Homo Sapiens
YLPTSLKNM

SEQ ID NO: 1405231 - protein, 9 aa, Homo Sapiens
TAAVPDLRH

SEQ ID NO: 1405232 - protein, 9 aa, Homo Sapiens
ASTQKRYIF

SEQ ID NO: 1405233 - protein, 9 aa, Homo Sapiens
PNKIRVRNG

SEQ ID NO: 1405234 - protein, 9 aa, Homo Sapiens
GSVTITGQH

SEQ ID NO: 1405235 - protein, 9 aa, Homo Sapiens
TLIVEVSVE

SEQ ID NO: 1405236 - protein, 9 aa, Homo Sapiens
DITVLCTFM

SEQ ID NO: 1405237 - protein, 9 aa, Homo Sapiens
SKWCRPWLE

SEQ ID NO: 1405238 - protein, 9 aa, Homo Sapiens
MAAMFGGHL

SEQ ID NO: 1405239 - protein, 9 aa, Homo Sapiens
LTAAVPDLR

SEQ ID NO: 1405240 - protein, 9 aa, Homo Sapiens
LVLPTCLLA

SEQ ID NO: 1405241 - protein, 9 aa, Homo Sapiens
LESKQNCSH

SEQ ID NO: 1405242 - protein, 9 aa, Homo Sapiens
TTLYVEESS

SEQ ID NO: 1405243 - protein, 9 aa, Homo Sapiens
AVTSSCSLQ

SEQ ID NO: 1405244 - protein, 9 aa, Homo Sapiens
SFSGPREPS

SEQ ID NO: 1405245 - protein, 9 aa, Homo Sapiens
VTASTHRPN

SEQ ID NO: 1405246 - protein, 9 aa, Homo Sapiens
AEATALSFS

SEQ ID NO: 1405247 - protein, 9 aa, Homo Sapiens
GIRKVCLLS

SEQ ID NO: 1405248 - protein, 9 aa, Homo Sapiens
QRSSLMRQV

SEQ ID NO: 1405249 - protein, 9 aa, Homo Sapiens
KVPALRLPA

SEQ ID NO: 1405250 - protein, 9 aa, Homo Sapiens
PNEGSSSQV

SEQ ID NO: 1405251 - protein, 9 aa, Homo Sapiens
GWEEPGGCT

SEQ ID NO: 1405252 - protein, 9 aa, Homo Sapiens
PHPPGHHDP

SEQ ID NO: 1405253 - protein, 9 aa, Homo Sapiens
GRLAGGSAN

SEQ ID NO: 1405254 - protein, 9 aa, Homo Sapiens
NVLALNFED

SEQ ID NO: 1405255 - protein, 9 aa, Homo Sapiens
TRSLGSLPQ

SEQ ID NO: 1405256 - protein, 9 aa, Homo Sapiens
RVRNGNRQW

SEQ ID NO: 1405257 - protein, 9 aa, Homo Sapiens
SFNHSLQAK

SEQ ID NO: 1405258 - protein, 9 aa, Homo Sapiens
IKELRKIHQ

SEQ ID NO: 1405259 - protein, 9 aa, Homo Sapiens
KLFSQLVEH

SEQ ID NO: 1405260 - protein, 9 aa, Homo Sapiens
RSSLYIHFK

SEQ ID NO: 1405261 - protein, 9 aa, Homo Sapiens
GGAAVREVC

SEQ ID NO: 1405262 - protein, 9 aa, Homo Sapiens
NNGQQSQEV

SEQ ID NO: 1405263 - protein, 9 aa, Homo Sapiens
LQEKSQGAL

SEQ ID NO: 1405264 - protein, 9 aa, Homo Sapiens
VEEGPSTSP

SEQ ID NO: 1405265 - protein, 9 aa, Homo Sapiens
PDLRHICGA

SEQ ID NO: 1405266 - protein, 9 aa, Homo Sapiens
KNNIPNKIR

SEQ ID NO: 1405267 - protein, 9 aa, Homo Sapiens
NETELTAAV

SEQ ID NO: 1405268 - protein, 9 aa, Homo Sapiens
NPFENKNVE

SEQ ID NO: 1405269 - protein, 9 aa, Homo Sapiens
SPSPTSSCW

SEQ ID NO: 1405270 - protein, 9 aa, Homo Sapiens
TMHREDLVV

SEQ ID NO: 1405271 - protein, 9 aa, Homo Sapiens
VEVNDINDN

SEQ ID NO: 1405272 - protein, 9 aa, Homo Sapiens
ELTAAVPDL

SEQ ID NO: 1405273 - protein, 9 aa, Homo Sapiens
KVHDIRLNG

SEQ ID NO: 1405274 - protein, 9 aa, Homo Sapiens
RRTKRGWML

SEQ ID NO: 1405275 - protein, 9 aa, Homo Sapiens
NYHSDTPTT

SEQ ID NO: 1405276 - protein, 9 aa, Homo Sapiens
FHHTAVLKP

SEQ ID NO: 1405277 - protein, 9 aa, Homo Sapiens
KFGIVVHEF

SEQ ID NO: 1405278 - protein, 9 aa, Homo Sapiens
GPKTYIWQD

SEQ ID NO: 1405279 - protein, 9 aa, Homo Sapiens
EDIHKTFEI

SEQ ID NO: 1405280 - protein, 9 aa, Homo Sapiens
LSTRSLGSL

SEQ ID NO: 1405281 - protein, 9 aa, Homo Sapiens
PSHGKRGSV

SEQ ID NO: 1405282 - protein, 9 aa, Homo Sapiens
WSPLLQDGG

SEQ ID NO: 1405283 - protein, 9 aa, Homo Sapiens
RWEKDSSHS

SEQ ID NO: 1405284 - protein, 9 aa, Homo Sapiens
MDVLASLKI

SEQ ID NO: 1405285 - protein, 9 aa, Homo Sapiens
MPYHQSAPH

SEQ ID NO: 1405286 - protein, 9 aa, Homo Sapiens
CSGVISARC

SEQ ID NO: 1405287 - protein, 9 aa, Homo Sapiens
HTFEIQYKK

SEQ ID NO: 1405288 - protein, 9 aa, Homo Sapiens
NRINEPLVI

SEQ ID NO: 1405289 - protein, 9 aa, Homo Sapiens
PPLPNVWVN

SEQ ID NO: 1405290 - protein, 9 aa, Homo Sapiens
NFHFWTRGI

SEQ ID NO: 1405291 - protein, 9 aa, Homo Sapiens
VTLNVTAAT

SEQ ID NO: 1405292 - protein, 9 aa, Homo Sapiens
IEHYSMDVL

SEQ ID NO: 1405293 - protein, 9 aa, Homo Sapiens
PGYEFQGEE

SEQ ID NO: 1405294 - protein, 9 aa, Homo Sapiens
IISVEILQS

SEQ ID NO: 1405295 - protein, 9 aa, Homo Sapiens
TNNYHNLYV

SEQ ID NO: 1405296 - protein, 9 aa, Homo Sapiens
GGSANTVRS

SEQ ID NO: 1405297 - protein, 9 aa, Homo Sapiens
SLLSTLSQP

SEQ ID NO: 1405298 - protein, 9 aa, Homo Sapiens
QNSSIQIHH

SEQ ID NO: 1405299 - protein, 9 aa, Homo Sapiens
ECHLQVVEA

SEQ ID NO: 1405300 - protein, 9 aa, Homo Sapiens
QPCSRQRQI

SEQ ID NO: 1405301 - protein, 9 aa, Homo Sapiens
YICSRHYRA

SEQ ID NO: 1405302 - protein, 9 aa, Homo Sapiens
IRMYSLRPE

SEQ ID NO: 1405303 - protein, 9 aa, Homo Sapiens
MPNLHPPMP

SEQ ID NO: 1405304 - protein, 9 aa, Homo Sapiens
CDPDWSSKN

SEQ ID NO: 1405305 - protein, 9 aa, Homo Sapiens
VGNTTASVT

SEQ ID NO: 1405306 - protein, 9 aa, Homo Sapiens
ASEENNGQQ

SEQ ID NO: 1405307 - protein, 9 aa, Homo Sapiens
YIFTNTFII

SEQ ID NO: 1405308 - protein, 9 aa, Homo Sapiens
TQKRYIFTN

SEQ ID NO: 1405309 - protein, 9 aa, Homo Sapiens
PHCDKCTRG

SEQ ID NO: 1405310 - protein, 9 aa, Homo Sapiens
AGLFHDTSI

SEQ ID NO: 1405311 - protein, 9 aa, Homo Sapiens
ERNNPDVSY

SEQ ID NO: 1405312 - protein, 9 aa, Homo Sapiens
SLAKELTHP

SEQ ID NO: 1405313 - protein, 9 aa, Homo Sapiens
HCASSEHTQ

SEQ ID NO: 1405314 - protein, 9 aa, Homo Sapiens
VVMLIFPVT

SEQ ID NO: 1405315 - protein, 9 aa, Homo Sapiens
IPPFEDDTP

SEQ ID NO: 1405316 - protein, 9 aa, Homo Sapiens
STSKHWNEK

SEQ ID NO: 1405317 - protein, 9 aa, Homo Sapiens
PLFCEFIRH

SEQ ID NO: 1405318 - protein, 9 aa, Homo Sapiens
ILQSTLSFC

SEQ ID NO: 1405319 - protein, 9 aa, Homo Sapiens
GDVGMAGAA

SEQ ID NO: 1405320 - protein, 9 aa, Homo Sapiens
ASTHRPNIL

SEQ ID NO: 1405321 - protein, 9 aa, Homo Sapiens
ALPRPSLTI

SEQ ID NO: 1405322 - protein, 9 aa, Homo Sapiens
KVVHVTVFD

SEQ ID NO: 1405323 - protein, 9 aa, Homo Sapiens
PLNPHIHLG

SEQ ID NO: 1405324 - protein, 9 aa, Homo Sapiens
CSQLLTFDI

SEQ ID NO: 1405325 - protein, 9 aa, Homo Sapiens
YICLKTYDN

SEQ ID NO: 1405326 - protein, 9 aa, Homo Sapiens
SNNWNSSTQ

SEQ ID NO: 1405327 - protein, 9 aa, Homo Sapiens
RGRACFCAL

SEQ ID NO: 1405328 - protein, 9 aa, Homo Sapiens
HPLGDTPQP

SEQ ID NO: 1405329 - protein, 9 aa, Homo Sapiens
NPESERNNP

SEQ ID NO: 1405330 - protein, 9 aa, Homo Sapiens
EGTSPPSSQ

SEQ ID NO: 1405331 - protein, 9 aa, Homo Sapiens
TGLYPLTAI

SEQ ID NO: 1405332 - protein, 9 aa, Homo Sapiens
EILQSTLSF

SEQ ID NO: 1405333 - protein, 9 aa, Homo Sapiens
YEPKDCYLQ

SEQ ID NO: 1405334 - protein, 9 aa, Homo Sapiens
KCSLTWSPL

SEQ ID NO: 1405335 - protein, 9 aa, Homo Sapiens
EGSSSQVEE

SEQ ID NO: 1405336 - protein, 9 aa, Homo Sapiens
LKIEDADPY

SEQ ID NO: 1405337 - protein, 9 aa, Homo Sapiens
PPFLESKQN

SEQ ID NO: 1405338 - protein, 9 aa, Homo Sapiens
HVDVEVNDI

SEQ ID NO: 1405339 - protein, 9 aa, Homo Sapiens
HVTLHATAQ

SEQ ID NO: 1405340 - protein, 9 aa, Homo Sapiens
AGKGVGGGA

SEQ ID NO: 1405341 - protein, 9 aa, Homo Sapiens
GKLLIVKCP

SEQ ID NO: 1405342 - protein, 9 aa, Homo Sapiens
FHHTVRKQT

SEQ ID NO: 1405343 - protein, 9 aa, Homo Sapiens
LPLTIFANW

SEQ ID NO: 1405344 - protein, 9 aa, Homo Sapiens
SIGDFLDSV

SEQ ID NO: 1405345 - protein, 9 aa, Homo Sapiens
VGPKTYIWQ

SEQ ID NO: 1405346 - protein, 9 aa, Homo Sapiens
LCTVWDPIA

SEQ ID NO: 1405347 - protein, 9 aa, Homo Sapiens
HERIHTSNK

SEQ ID NO: 1405348 - protein, 9 aa, Homo Sapiens
VVPAGKGVG

SEQ ID NO: 1405349 - protein, 9 aa, Homo Sapiens
MLSWHQATH

SEQ ID NO: 1405350 - protein, 9 aa, Homo Sapiens
AAKNTRAQS

SEQ ID NO: 1405351 - protein, 9 aa, Homo Sapiens
GETKWECKA

SEQ ID NO: 1405352 - protein, 9 aa, Homo Sapiens
AKRKLYQFL

SEQ ID NO: 1405353 - protein, 9 aa, Homo Sapiens
ATNIDLSDK

SEQ ID NO: 1405354 - protein, 9 aa, Homo Sapiens
PHKMASYIY

SEQ ID NO: 1405355 - protein, 9 aa, Homo Sapiens
PYICAKCGK

SEQ ID NO: 1405356 - protein, 9 aa, Homo Sapiens
KARGEAKKR

SEQ ID NO: 1405357 - protein, 9 aa, Homo Sapiens
LCPLMLSWH

SEQ ID NO: 1405358 - protein, 9 aa, Homo Sapiens
YIWQDNERV

SEQ ID NO: 1405359 - protein, 9 aa, Homo Sapiens
ICQRDVILT

SEQ ID NO: 1405360 - protein, 9 aa, Homo Sapiens
PDLHLKALK

SEQ ID NO: 1405361 - protein, 9 aa, Homo Sapiens
ATTFNGLTP

SEQ ID NO: 1405362 - protein, 9 aa, Homo Sapiens
GTKVPALRL

SEQ ID NO: 1405363 - protein, 9 aa, Homo Sapiens
AVPAAACPP

SEQ ID NO: 1405364 - protein, 9 aa, Homo Sapiens
RKIFQNHRI

SEQ ID NO: 1405365 - protein, 9 aa, Homo Sapiens
CQRDVILTH

SEQ ID NO: 1405366 - protein, 9 aa, Homo Sapiens
SRQRQILHL

SEQ ID NO: 1405367 - protein, 9 aa, Homo Sapiens
SLVTLLLAL

SEQ ID NO: 1405368 - protein, 9 aa, Homo Sapiens
EKPYICAKC

SEQ ID NO: 1405369 - protein, 9 aa, Homo Sapiens
IVVHEFGHV

SEQ ID NO: 1405370 - protein, 9 aa, Homo Sapiens
ICVADQCHG

SEQ ID NO: 1405371 - protein, 9 aa, Homo Sapiens
DLMLVGPTG

SEQ ID NO: 1405372 - protein, 9 aa, Homo Sapiens
WEKDSSHSG

SEQ ID NO: 1405373 - protein, 9 aa, Homo Sapiens
CQHKLPAQK

SEQ ID NO: 1405374 - protein, 9 aa, Homo Sapiens
LNPHIHLGT

SEQ ID NO: 1405375 - protein, 9 aa, Homo Sapiens
NGSNTSSLI

SEQ ID NO: 1405376 - protein, 9 aa, Homo Sapiens
DIHKTFEIN

SEQ ID NO: 1405377 - protein, 9 aa, Homo Sapiens
PGHASRENP

SEQ ID NO: 1405378 - protein, 9 aa, Homo Sapiens
CCLPGLTHP

SEQ ID NO: 1405379 - protein, 9 aa, Homo Sapiens
EDEENKYLD

SEQ ID NO: 1405380 - protein, 9 aa, Homo Sapiens
HERYYDITV

SEQ ID NO: 1405381 - protein, 9 aa, Homo Sapiens
STHRPNILI

SEQ ID NO: 1405382 - protein, 9 aa, Homo Sapiens
LDSDGSLLQ

SEQ ID NO: 1405383 - protein, 9 aa, Homo Sapiens
RIQKSDFSN

SEQ ID NO: 1405384 - protein, 9 aa, Homo Sapiens
ATALSFSGP

SEQ ID NO: 1405385 - protein, 9 aa, Homo Sapiens
QAGTIVEAH

SEQ ID NO: 1405386 - protein, 9 aa, Homo Sapiens
KENFSLKLC

SEQ ID NO: 1405387 - protein, 9 aa, Homo Sapiens
TQFLMAMFQ

SEQ ID NO: 1405388 - protein, 9 aa, Homo Sapiens
FSNNWNSST

SEQ ID NO: 1405389 - protein, 9 aa, Homo Sapiens
RSLGSLPQQ

SEQ ID NO: 1405390 - protein, 9 aa, Homo Sapiens
ECLQSRVTN

SEQ ID NO: 1405391 - protein, 9 aa, Homo Sapiens
NWKDKDPTE

SEQ ID NO: 1405392 - protein, 9 aa, Homo Sapiens
SANTVRSPA

SEQ ID NO: 1405393 - protein, 9 aa, Homo Sapiens
GSSETLLEV

SEQ ID NO: 1405394 - protein, 9 aa, Homo Sapiens
LYSHYLPTS

SEQ ID NO: 1405395 - protein, 9 aa, Homo Sapiens
IEGRWKKLF

SEQ ID NO: 1405396 - protein, 9 aa, Homo Sapiens
QFLMAMFQA

SEQ ID NO: 1405397 - protein, 9 aa, Homo Sapiens
LYTCNQYGK

SEQ ID NO: 1405398 - protein, 9 aa, Homo Sapiens
ASMASLKKN

SEQ ID NO: 1405399 - protein, 9 aa, Homo Sapiens
KNRILKQML

SEQ ID NO: 1405400 - protein, 9 aa, Homo Sapiens
PDRELQPWC

SEQ ID NO: 1405401 - protein, 9 aa, Homo Sapiens
PAVPAAACP

SEQ ID NO: 1405402 - protein, 9 aa, Homo Sapiens
VAGLFHDTS

SEQ ID NO: 1405403 - protein, 9 aa, Homo Sapiens
RETGLFLPS

SEQ ID NO: 1405404 - protein, 9 aa, Homo Sapiens
RVLHQNLDP

SEQ ID NO: 1405405 - protein, 9 aa, Homo Sapiens
QCTTLYVEE

SEQ ID NO: 1405406 - protein, 9 aa, Homo Sapiens
RCPGHASRE

SEQ ID NO: 1405407 - protein, 9 aa, Homo Sapiens
DGSPVLKSC

SEQ ID NO: 1405408 - protein, 9 aa, Homo Sapiens
PNPESERNN

SEQ ID NO: 1405409 - protein, 9 aa, Homo Sapiens
TKWECKAYL

SEQ ID NO: 1405410 - protein, 9 aa, Homo Sapiens
AFFLTTLLI

SEQ ID NO: 1405411 - protein, 9 aa, Homo Sapiens
SEHTQMVAF

SEQ ID NO: 1405412 - protein, 9 aa, Homo Sapiens
EAGIKVHDI

SEQ ID NO: 1405413 - protein, 9 aa, Homo Sapiens
KSQCTTLYV

SEQ ID NO: 1405414 - protein, 9 aa, Homo Sapiens
IIRNFQKNR

SEQ ID NO: 1405415 - protein, 9 aa, Homo Sapiens
LVPLFCEFI

SEQ ID NO: 1405416 - protein, 9 aa, Homo Sapiens
CIEGVDFEI

SEQ ID NO: 1405417 - protein, 9 aa, Homo Sapiens
KPFFLFGEI

SEQ ID NO: 1405418 - protein, 9 aa, Homo Sapiens
PYECSECGW

SEQ ID NO: 1405419 - protein, 9 aa, Homo Sapiens
LPSRAPASP

SEQ ID NO: 1405420 - protein, 9 aa, Homo Sapiens
ITSSIHDTE

SEQ ID NO: 1405421 - protein, 9 aa, Homo Sapiens
GEKPYICAK

SEQ ID NO: 1405422 - protein, 9 aa, Homo Sapiens
SDTPTTHLG

SEQ ID NO: 1405423 - protein, 9 aa, Homo Sapiens
STLSFCQHK

SEQ ID NO: 1405424 - protein, 9 aa, Homo Sapiens
WTAATLRCP

SEQ ID NO: 1405425 - protein, 9 aa, Homo Sapiens
RFSTASLAK

SEQ ID NO: 1405426 - protein, 9 aa, Homo Sapiens
MAMFQATSQ

SEQ ID NO: 1405427 - protein, 9 aa, Homo Sapiens
FYSDLNSEQ

SEQ ID NO: 1405428 - protein, 9 aa, Homo Sapiens
MADNVNYFI

SEQ ID NO: 1405429 - protein, 9 aa, Homo Sapiens
ADPYHAYVC

SEQ ID NO: 1405430 - protein, 9 aa, Homo Sapiens
VAATHCHND

SEQ ID NO: 1405431 - protein, 9 aa, Homo Sapiens
TLRCPAVPA

SEQ ID NO: 1405432 - protein, 9 aa, Homo Sapiens
KIERNFPPY

SEQ ID NO: 1405433 - protein, 9 aa, Homo Sapiens
SFFVMFLMY

SEQ ID NO: 1405434 - protein, 9 aa, Homo Sapiens
EAAEKIYIS

SEQ ID NO: 1405435 - protein, 9 aa, Homo Sapiens
GTSPPSSQL

SEQ ID NO: 1405436 - protein, 9 aa, Homo Sapiens
SLGAFSHVT

SEQ ID NO: 1405437 - protein, 9 aa, Homo Sapiens
IRIDSHLHT

SEQ ID NO: 1405438 - protein, 9 aa, Homo Sapiens
ILEVSYIKV

SEQ ID NO: 1405439 - protein, 9 aa, Homo Sapiens
QQWEARKKP

SEQ ID NO: 1405440 - protein, 9 aa, Homo Sapiens
LASEDRRET

SEQ ID NO: 1405441 - protein, 9 aa, Homo Sapiens
VCLLSTRSL

SEQ ID NO: 1405442 - protein, 9 aa, Homo Sapiens
RRKRIPFSK

SEQ ID NO: 1405443 - protein, 9 aa, Homo Sapiens
EFQGEERIT

SEQ ID NO: 1405444 - protein, 9 aa, Homo Sapiens
LQDLGLRMV

SEQ ID NO: 1405445 - protein, 9 aa, Homo Sapiens
LQRWFCRMW

SEQ ID NO: 1405446 - protein, 9 aa, Homo Sapiens
TESHHRAKG

SEQ ID NO: 1405447 - protein, 9 aa, Homo Sapiens
SLMRQVFKS

SEQ ID NO: 1405448 - protein, 9 aa, Homo Sapiens
QLKIEDADP

SEQ ID NO: 1405449 - protein, 9 aa, Homo Sapiens
PEFRCLGLA

SEQ ID NO: 1405450 - protein, 9 aa, Homo Sapiens
FGKRILDEE

SEQ ID NO: 1405451 - protein, 9 aa, Homo Sapiens
EASSRPKRK

SEQ ID NO: 1405452 - protein, 9 aa, Homo Sapiens
PNEVNPFEN

SEQ ID NO: 1405453 - protein, 9 aa, Homo Sapiens
RGETKWECK

SEQ ID NO: 1405454 - protein, 9 aa, Homo Sapiens
LGELALVIF

SEQ ID NO: 1405455 - protein, 9 aa, Homo Sapiens
KNMINTEEC

SEQ ID NO: 1405456 - protein, 9 aa, Homo Sapiens
SEPNEVNPF

SEQ ID NO: 1405457 - protein, 9 aa, Homo Sapiens
RDPEWWLQH

SEQ ID NO: 1405458 - protein, 9 aa, Homo Sapiens
QQSLPGPGR

SEQ ID NO: 1405459 - protein, 9 aa, Homo Sapiens
SRGETKWEC

SEQ ID NO: 1405460 - protein, 9 aa, Homo Sapiens
SDGSLLQDI

SEQ ID NO: 1405461 - protein, 9 aa, Homo Sapiens
SLIGINTSV

SEQ ID NO: 1405462 - protein, 9 aa, Homo Sapiens
SPSPSPTSS

SEQ ID NO: 1405463 - protein, 9 aa, Homo Sapiens
IQYKKDTAT

SEQ ID NO: 1405464 - protein, 9 aa, Homo Sapiens
GVEGPHCDK

SEQ ID NO: 1405465 - protein, 9 aa, Homo Sapiens
ETELTAAVP

SEQ ID NO: 1405466 - protein, 9 aa, Homo Sapiens
DEDVTGAVV

SEQ ID NO: 1405467 - protein, 9 aa, Homo Sapiens
MPTSYRCSR

SEQ ID NO: 1405468 - protein, 9 aa, Homo Sapiens
SCWGLVLPT

SEQ ID NO: 1405469 - protein, 9 aa, Homo Sapiens
PDLDKTKNF

SEQ ID NO: 1405470 - protein, 9 aa, Homo Sapiens
HPPGHHDPP

SEQ ID NO: 1405471 - protein, 9 aa, Homo Sapiens
QPSLHHQLS

SEQ ID NO: 1405472 - protein, 9 aa, Homo Sapiens
HKTINTDLS

SEQ ID NO: 1405473 - protein, 9 aa, Homo Sapiens
EKPQIFTKS

SEQ ID NO: 1405474 - protein, 9 aa, Homo Sapiens
YFHHWPVFV

SEQ ID NO: 1405475 - protein, 9 aa, Homo Sapiens
HHPLGDTPQ

SEQ ID NO: 1405476 - protein, 9 aa, Homo Sapiens
IFRHQKLHT

SEQ ID NO: 1405477 - protein, 9 aa, Homo Sapiens
MHKTINTDL

SEQ ID NO: 1405478 - protein, 9 aa, Homo Sapiens
WNLNPVFGG

SEQ ID NO: 1405479 - protein, 9 aa, Homo Sapiens
ATLYCDPDW

SEQ ID NO: 1405480 - protein, 9 aa, Homo Sapiens
ELHQKSPLF

SEQ ID NO: 1405481 - protein, 9 aa, Homo Sapiens
HTAVLKPES

SEQ ID NO: 1405482 - protein, 9 aa, Homo Sapiens
RCNLCLPDS

SEQ ID NO: 1405483 - protein, 9 aa, Homo Sapiens
SSSRGDTGA

SEQ ID NO: 1405484 - protein, 9 aa, Homo Sapiens
TLLEVNENR

SEQ ID NO: 1405485 - protein, 9 aa, Homo Sapiens
GAAVREVCE

SEQ ID NO: 1405486 - protein, 9 aa, Homo Sapiens
RRCRHHERC

SEQ ID NO: 1405487 - protein, 9 aa, Homo Sapiens
TAAFFLTTL

SEQ ID NO: 1405488 - protein, 9 aa, Homo Sapiens
DTKTLEGPS

SEQ ID NO: 1405489 - protein, 9 aa, Homo Sapiens
LNEVNNFPQ

SEQ ID NO: 1405490 - protein, 9 aa, Homo Sapiens
PPPKIERNF

SEQ ID NO: 1405491 - protein, 9 aa, Homo Sapiens
TQLTTMCED

SEQ ID NO: 1405492 - protein, 9 aa, Homo Sapiens
KERFVRKKV

SEQ ID NO: 1405493 - protein, 9 aa, Homo Sapiens
CRELHPRYL

SEQ ID NO: 1405494 - protein, 9 aa, Homo Sapiens
AKKRRKVYG

SEQ ID NO: 1405495 - protein, 9 aa, Homo Sapiens
HDLMLVGPT

SEQ ID NO: 1405496 - protein, 9 aa, Homo Sapiens
SECIEPVHN

SEQ ID NO: 1405497 - protein, 9 aa, Homo Sapiens
KALSFNHSL

SEQ ID NO: 1405498 - protein, 9 aa, Homo Sapiens
ATKMATIAT

SEQ ID NO: 1405499 - protein, 9 aa, Homo Sapiens
AYSATNIDL

SEQ ID NO: 1405500 - protein, 9 aa, Homo Sapiens
VIASTDPEL

SEQ ID NO: 1405501 - protein, 9 aa, Homo Sapiens
DSDGSLLQD

SEQ ID NO: 1405502 - protein, 9 aa, Homo Sapiens
GNSLIIFTI

SEQ ID NO: 1405503 - protein, 9 aa, Homo Sapiens
VGLRLLRVL

SEQ ID NO: 1405504 - protein, 9 aa, Homo Sapiens
CPLMLSWHQ

SEQ ID NO: 1405505 - protein, 9 aa, Homo Sapiens
HTSNKPYEC

SEQ ID NO: 1405506 - protein, 9 aa, Homo Sapiens
TGAVVLQVG

SEQ ID NO: 1405507 - protein, 9 aa, Homo Sapiens
RTVVEKLRR

SEQ ID NO: 1405508 - protein, 9 aa, Homo Sapiens
SRVLRRMVP

SEQ ID NO: 1405509 - protein, 9 aa, Homo Sapiens
TSTPACSPP

SEQ ID NO: 1405510 - protein, 9 aa, Homo Sapiens
PRKNAFHHT

SEQ ID NO: 1405511 - protein, 9 aa, Homo Sapiens
EHYSMDVLA

SEQ ID NO: 1405512 - protein, 9 aa, Homo Sapiens
GYNTGLYPL

SEQ ID NO: 1405513 - protein, 9 aa, Homo Sapiens
KSTYLHKLR

SEQ ID NO: 1405514 - protein, 9 aa, Homo Sapiens
AVPDLRHIC

SEQ ID NO: 1405515 - protein, 9 aa, Homo Sapiens
YYPCFWGSD

SEQ ID NO: 1405516 - protein, 9 aa, Homo Sapiens
QEELRTVVE

SEQ ID NO: 1405517 - protein, 9 aa, Homo Sapiens
VEGPHCDKC

SEQ ID NO: 1405518 - protein, 9 aa, Homo Sapiens
VPLFCEFIR

SEQ ID NO: 1405519 - protein, 9 aa, Homo Sapiens
IKRPKNAFM

SEQ ID NO: 1405520 - protein, 9 aa, Homo Sapiens
TVTSTIHLT

SEQ ID NO: 1405521 - protein, 9 aa, Homo Sapiens
TGARDPEWW

SEQ ID NO: 1405522 - protein, 9 aa, Homo Sapiens
HTQMVAFDQ

SEQ ID NO: 1405523 - protein, 9 aa, Homo Sapiens
DEENKYLDV

SEQ ID NO: 1405524 - protein, 9 aa, Homo Sapiens
LTKQSGHTQ

SEQ ID NO: 1405525 - protein, 9 aa, Homo Sapiens
LHLVKPRVL

SEQ ID NO: 1405526 - protein, 9 aa, Homo Sapiens
PSLTINGSN

SEQ ID NO: 1405527 - protein, 9 aa, Homo Sapiens
GGTPLSISR

SEQ ID NO: 1405528 - protein, 9 aa, Homo Sapiens
TTMCEDFSN

SEQ ID NO: 1405529 - protein, 9 aa, Homo Sapiens
IPNKIRVRN

SEQ ID NO: 1405530 - protein, 9 aa, Homo Sapiens
AHFLKTWFR

SEQ ID NO: 1405531 - protein, 9 aa, Homo Sapiens
NPLLEQLKK

SEQ ID NO: 1405532 - protein, 9 aa, Homo Sapiens
ARQAINDGS

SEQ ID NO: 1405533 - protein, 9 aa, Homo Sapiens
YSMDVLASL

SEQ ID NO: 1405534 - protein, 9 aa, Homo Sapiens
WTMATLYCD

SEQ ID NO: 1405535 - protein, 9 aa, Homo Sapiens
SYIYCFMAV

SEQ ID NO: 1405536 - protein, 9 aa, Homo Sapiens
CRFETLQLS

SEQ ID NO: 1405537 - protein, 9 aa, Homo Sapiens
ISENFYSDL

SEQ ID NO: 1405538 - protein, 9 aa, Homo Sapiens
FQGEERITC

SEQ ID NO: 1405539 - protein, 9 aa, Homo Sapiens
PPASWAPQM

SEQ ID NO: 1405540 - protein, 9 aa, Homo Sapiens
LVIFSVVNA

SEQ ID NO: 1405541 - protein, 9 aa, Homo Sapiens
RGSVDSLVE

SEQ ID NO: 1405542 - protein, 9 aa, Homo Sapiens
PEMPTSYRC

SEQ ID NO: 1405543 - protein, 9 aa, Homo Sapiens
YIYCFMAVT

SEQ ID NO: 1405544 - protein, 9 aa, Homo Sapiens
GKKEDEENK

SEQ ID NO: 1405545 - protein, 9 aa, Homo Sapiens
SRTPPRRVC

SEQ ID NO: 1405546 - protein, 9 aa, Homo Sapiens
REKLPLTIF

SEQ ID NO: 1405547 - protein, 9 aa, Homo Sapiens
MLLEDIKRF

SEQ ID NO: 1405548 - protein, 9 aa, Homo Sapiens
EEKIKELRK

SEQ ID NO: 1405549 - protein, 9 aa, Homo Sapiens
ALSFNHSLQ

SEQ ID NO: 1405550 - protein, 9 aa, Homo Sapiens
AINDGSPVL

SEQ ID NO: 1405551 - protein, 9 aa, Homo Sapiens
RKQTLNFHF

SEQ ID NO: 1405552 - protein, 9 aa, Homo Sapiens
SMYQNSSIQ

SEQ ID NO: 1405553 - protein, 9 aa, Homo Sapiens
RMVEIGDEN

SEQ ID NO: 1405554 - protein, 9 aa, Homo Sapiens
FLLVYTLTI

SEQ ID NO: 1405555 - protein, 9 aa, Homo Sapiens
RRPQPNKSA

SEQ ID NO: 1405556 - protein, 9 aa, Homo Sapiens
MGGMSRTPP

SEQ ID NO: 1405557 - protein, 9 aa, Homo Sapiens
WQEFVLEMH

SEQ ID NO: 1405558 - protein, 9 aa, Homo Sapiens
HLASKESCV

SEQ ID NO: 1405559 - protein, 9 aa, Homo Sapiens
YNDSARRKR

SEQ ID NO: 1405560 - protein, 9 aa, Homo Sapiens
ISLAPQTLV

SEQ ID NO: 1405561 - protein, 9 aa, Homo Sapiens
ICLKTYDNP

SEQ ID NO: 1405562 - protein, 9 aa, Homo Sapiens
RGDTGARDP

SEQ ID NO: 1405563 - protein, 9 aa, Homo Sapiens
EIDEKERRI

SEQ ID NO: 1405564 - protein, 9 aa, Homo Sapiens
YSHYLPTSL

SEQ ID NO: 1405565 - protein, 9 aa, Homo Sapiens
LGDTPQPSL

SEQ ID NO: 1405566 - protein, 9 aa, Homo Sapiens
SHYLPTSLK

SEQ ID NO: 1405567 - protein, 9 aa, Homo Sapiens
PKERPLGRK

SEQ ID NO: 1405568 - protein, 9 aa, Homo Sapiens
LTVEWSARS

SEQ ID NO: 1405569 - protein, 9 aa, Homo Sapiens
LYRNMAKLG

SEQ ID NO: 1405570 - protein, 9 aa, Homo Sapiens
EGTIVNVPK

SEQ ID NO: 1405571 - protein, 9 aa, Homo Sapiens
WRIGGGTPL

SEQ ID NO: 1405572 - protein, 9 aa, Homo Sapiens
PHLLQPASL

SEQ ID NO: 1405573 - protein, 9 aa, Homo Sapiens
TPLLASEDR

SEQ ID NO: 1405574 - protein, 9 aa, Homo Sapiens
IHFKKHLQD

SEQ ID NO: 1405575 - protein, 9 aa, Homo Sapiens
LCIYFLEER

SEQ ID NO: 1405576 - protein, 9 aa, Homo Sapiens
MINTEECIT

SEQ ID NO: 1405577 - protein, 9 aa, Homo Sapiens
EGMYLLITG

SEQ ID NO: 1405578 - protein, 9 aa, Homo Sapiens
EWIAVRHEP

SEQ ID NO: 1405579 - protein, 9 aa, Homo Sapiens
AAIDTVEDT

SEQ ID NO: 1405580 - protein, 9 aa, Homo Sapiens
QNNSYCRET

SEQ ID NO: 1405581 - protein, 9 aa, Homo Sapiens
FTISLAPQT

SEQ ID NO: 1405582 - protein, 9 aa, Homo Sapiens
DLHLKALKI

SEQ ID NO: 1405583 - protein, 9 aa, Homo Sapiens
ALPAPEIRL

SEQ ID NO: 1405584 - protein, 9 aa, Homo Sapiens
TSLKNMVDQ

SEQ ID NO: 1405585 - protein, 9 aa, Homo Sapiens
VEASSSECI

SEQ ID NO: 1405586 - protein, 9 aa, Homo Sapiens
PKKTESHHR

SEQ ID NO: 1405587 - protein, 9 aa, Homo Sapiens
VWTAATLRC

SEQ ID NO: 1405588 - protein, 9 aa, Homo Sapiens
IEPVHNLLP

SEQ ID NO: 1405589 - protein, 9 aa, Homo Sapiens
HNLLPVLMV

SEQ ID NO: 1405590 - protein, 9 aa, Homo Sapiens
LSKGGEQVC

SEQ ID NO: 1405591 - protein, 9 aa, Homo Sapiens
WMLNQFFLL

SEQ ID NO: 1405592 - protein, 9 aa, Homo Sapiens
NRFVIWGSL

SEQ ID NO: 1405593 - protein, 9 aa, Homo Sapiens
DVEVNDIND

SEQ ID NO: 1405594 - protein, 9 aa, Homo Sapiens
LVTLLLALP

SEQ ID NO: 1405595 - protein, 9 aa, Homo Sapiens
TICAKRKLY

SEQ ID NO: 1405596 - protein, 9 aa, Homo Sapiens
IENSSWTMT

SEQ ID NO: 1405597 - protein, 9 aa, Homo Sapiens
VRHDLMLVG

SEQ ID NO: 1405598 - protein, 9 aa, Homo Sapiens
AETLRVLRL

SEQ ID NO: 1405599 - protein, 9 aa, Homo Sapiens
LQCSVAWGP

SEQ ID NO: 1405600 - protein, 9 aa, Homo Sapiens
DHTFEIQYK

SEQ ID NO: 1405601 - protein, 9 aa, Homo Sapiens
LLLKEKQDG

SEQ ID NO: 1405602 - protein, 9 aa, Homo Sapiens
YSATNIDLS

SEQ ID NO: 1405603 - protein, 9 aa, Homo Sapiens
SVNRRIMET

SEQ ID NO: 1405604 - protein, 9 aa, Homo Sapiens
PDIRGRACF

SEQ ID NO: 1405605 - protein, 9 aa, Homo Sapiens
GPHCDKCTR

SEQ ID NO: 1405606 - protein, 9 aa, Homo Sapiens
SSPKGSGTE

SEQ ID NO: 1405607 - protein, 9 aa, Homo Sapiens
RGWMLNQFF

SEQ ID NO: 1405608 - protein, 9 aa, Homo Sapiens
PPMPPSALN

SEQ ID NO: 1405609 - protein, 9 aa, Homo Sapiens
LAVAATHCH

SEQ ID NO: 1405610 - protein, 9 aa, Homo Sapiens
NREKLPLTI

SEQ ID NO: 1405611 - protein, 9 aa, Homo Sapiens
GELALVIFS

SEQ ID NO: 1405612 - protein, 9 aa, Homo Sapiens
TRVKLTKQS

SEQ ID NO: 1405613 - protein, 9 aa, Homo Sapiens
FLESKQNCS

SEQ ID NO: 1405614 - protein, 9 aa, Homo Sapiens
VALLADLGF

SEQ ID NO: 1405615 - protein, 9 aa, Homo Sapiens
LQSRVTNQT

SEQ ID NO: 1405616 - protein, 9 aa, Homo Sapiens
SRGDTGARD

SEQ ID NO: 1405617 - protein, 9 aa, Homo Sapiens
KMATIATDT

SEQ ID NO: 1405618 - protein, 9 aa, Homo Sapiens
TTVVRHDLM

SEQ ID NO: 1405619 - protein, 9 aa, Homo Sapiens
LNFEDFKND

SEQ ID NO: 1405620 - protein, 9 aa, Homo Sapiens
YIHFKKHLQ

SEQ ID NO: 1405621 - protein, 9 aa, Homo Sapiens
GGAAKNTRA

SEQ ID NO: 1405622 - protein, 9 aa, Homo Sapiens
FTLLRCLSL

SEQ ID NO: 1405623 - protein, 9 aa, Homo Sapiens
VNTHIFRHQ

SEQ ID NO: 1405624 - protein, 9 aa, Homo Sapiens
PCIVCSCIE

SEQ ID NO: 1405625 - protein, 9 aa, Homo Sapiens
RKRKQEEKM

SEQ ID NO: 1405626 - protein, 9 aa, Homo Sapiens
TVWDPIAAG

SEQ ID NO: 1405627 - protein, 9 aa, Homo Sapiens
EFRCLGLAA

SEQ ID NO: 1405628 - protein, 9 aa, Homo Sapiens
FSTASLAKE

SEQ ID NO: 1405629 - protein, 9 aa, Homo Sapiens
GQQSQEVPE

SEQ ID NO: 1405630 - protein, 9 aa, Homo Sapiens
HPLLVSLLL

SEQ ID NO: 1405631 - protein, 9 aa, Homo Sapiens
TTGIRKVCL

SEQ ID NO: 1405632 - protein, 9 aa, Homo Sapiens
FNHSLQAKS

SEQ ID NO: 1405633 - protein, 9 aa, Homo Sapiens
FTAHQTHLA

SEQ ID NO: 1405634 - protein, 9 aa, Homo Sapiens
PPVSNQPVT

SEQ ID NO: 1405635 - protein, 9 aa, Homo Sapiens
MVITAPPVS

SEQ ID NO: 1405636 - protein, 9 aa, Homo Sapiens
SHASEDIHK

SEQ ID NO: 1405637 - protein, 9 aa, Homo Sapiens
VLALNFEDF

SEQ ID NO: 1405638 - protein, 9 aa, Homo Sapiens
PMPPSALNP

SEQ ID NO: 1405639 - protein, 9 aa, Homo Sapiens
TQARAACGP

SEQ ID NO: 1405640 - protein, 9 aa, Homo Sapiens
LRKIHQLEL

SEQ ID NO: 1405641 - protein, 9 aa, Homo Sapiens
LPPTVTSTI

SEQ ID NO: 1405642 - protein, 9 aa, Homo Sapiens
VSESPELHQ

SEQ ID NO: 1405643 - protein, 9 aa, Homo Sapiens
LVSLLLKEK

SEQ ID NO: 1405644 - protein, 9 aa, Homo Sapiens
PKKNSRKLR

SEQ ID NO: 1405645 - protein, 9 aa, Homo Sapiens
ACSVTYSAL

SEQ ID NO: 1405646 - protein, 9 aa, Homo Sapiens
KGKSSLLDF

SEQ ID NO: 1405647 - protein, 9 aa, Homo Sapiens
TPRGMPYHQ

SEQ ID NO: 1405648 - protein, 9 aa, Homo Sapiens
GSANTVRSP

SEQ ID NO: 1405649 - protein, 9 aa, Homo Sapiens
SHGKRGSVD

SEQ ID NO: 1405650 - protein, 9 aa, Homo Sapiens
GEAKKRRKV

SEQ ID NO: 1405651 - protein, 9 aa, Homo Sapiens
EECITLENS

SEQ ID NO: 1405652 - protein, 9 aa, Homo Sapiens
FWTWINRFV

SEQ ID NO: 1405653 - protein, 9 aa, Homo Sapiens
EFLNVLALN

SEQ ID NO: 1405654 - protein, 9 aa, Homo Sapiens
FHDTSIGNP

SEQ ID NO: 1405655 - protein, 9 aa, Homo Sapiens
QIWNLNPVF

SEQ ID NO: 1405656 - protein, 9 aa, Homo Sapiens
AVLKPESGC

SEQ ID NO: 1405657 - protein, 9 aa, Homo Sapiens
VIIPPFEDD

SEQ ID NO: 1405658 - protein, 9 aa, Homo Sapiens
NFPPYNGFG

SEQ ID NO: 1405659 - protein, 9 aa, Homo Sapiens
AGMLLDYFH

SEQ ID NO: 1405660 - protein, 9 aa, Homo Sapiens
SYICSRHYR

SEQ ID NO: 1405661 - protein, 9 aa, Homo Sapiens
LGEKPQIFT

SEQ ID NO: 1405662 - protein, 9 aa, Homo Sapiens
KMETEQQNK

SEQ ID NO: 1405663 - protein, 9 aa, Homo Sapiens
VRHEPTLLP

SEQ ID NO: 1405664 - protein, 9 aa, Homo Sapiens
GNTTASVTL

SEQ ID NO: 1405665 - protein, 9 aa, Homo Sapiens
SFKVNTHIF

SEQ ID NO: 1405666 - protein, 9 aa, Homo Sapiens
TVCKESFAQ

SEQ ID NO: 1405667 - protein, 9 aa, Homo Sapiens
EEIVQVGKE

SEQ ID NO: 1405668 - protein, 9 aa, Homo Sapiens
LMQLMWLYL

SEQ ID NO: 1405669 - protein, 9 aa, Homo Sapiens
RILKQMLPE

SEQ ID NO: 1405670 - protein, 9 aa, Homo Sapiens
KLPAQKTAR

SEQ ID NO: 1405671 - protein, 9 aa, Homo Sapiens
PQDTEIIDT

SEQ ID NO: 1405672 - protein, 9 aa, Homo Sapiens
SGQPCSRQR

SEQ ID NO: 1405673 - protein, 9 aa, Homo Sapiens
SPHGNLLVS

SEQ ID NO: 1405674 - protein, 9 aa, Homo Sapiens
VSGLCPLML

SEQ ID NO: 1405675 - protein, 9 aa, Homo Sapiens
LALNFEDFK

SEQ ID NO: 1405676 - protein, 9 aa, Homo Sapiens
IFGEAAEKI

SEQ ID NO: 1405677 - protein, 9 aa, Homo Sapiens
VCKESFAQK

SEQ ID NO: 1405678 - protein, 9 aa, Homo Sapiens
LLSTLSQPP

SEQ ID NO: 1405679 - protein, 9 aa, Homo Sapiens
NLKERFVRK

SEQ ID NO: 1405680 - protein, 9 aa, Homo Sapiens
NFPQKISYT

SEQ ID NO: 1405681 - protein, 9 aa, Homo Sapiens
ENTNNYHNL

SEQ ID NO: 1405682 - protein, 9 aa, Homo Sapiens
EDQSALYVT

SEQ ID NO: 1405683 - protein, 9 aa, Homo Sapiens
SPPAPTWMT

SEQ ID NO: 1405684 - protein, 9 aa, Homo Sapiens
PSPSPTSSC

SEQ ID NO: 1405685 - protein, 9 aa, Homo Sapiens
HLCRELHPR

SEQ ID NO: 1405686 - protein, 9 aa, Homo Sapiens
VVRHDLMLV

SEQ ID NO: 1405687 - protein, 9 aa, Homo Sapiens
YIEVEDVSD

SEQ ID NO: 1405688 - protein, 9 aa, Homo Sapiens
KKGSVERRW

SEQ ID NO: 1405689 - protein, 9 aa, Homo Sapiens
SLQAKSTYL

SEQ ID NO: 1405690 - protein, 9 aa, Homo Sapiens
VDSLVEAVL

SEQ ID NO: 1405691 - protein, 9 aa, Homo Sapiens
PAGKGVGGG

SEQ ID NO: 1405692 - protein, 9 aa, Homo Sapiens
PPFEDDTPR

SEQ ID NO: 1405693 - protein, 9 aa, Homo Sapiens
LFSQLVEHC

SEQ ID NO: 1405694 - protein, 9 aa, Homo Sapiens
HHVVILFVL

SEQ ID NO: 1405695 - protein, 9 aa, Homo Sapiens
HLKALKISM

SEQ ID NO: 1405696 - protein, 9 aa, Homo Sapiens
TELTAAVPD

SEQ ID NO: 1405697 - protein, 9 aa, Homo Sapiens
GGNDKQGFH

SEQ ID NO: 1405698 - protein, 9 aa, Homo Sapiens
HTIEVNRCR

SEQ ID NO: 1405699 - protein, 9 aa, Homo Sapiens
VAEALTLPQ

SEQ ID NO: 1405700 - protein, 9 aa, Homo Sapiens
PTSLKNMVD

SEQ ID NO: 1405701 - protein, 9 aa, Homo Sapiens
GSSSRGDTG

SEQ ID NO: 1405702 - protein, 9 aa, Homo Sapiens
LDLHHGLGL

SEQ ID NO: 1405703 - protein, 9 aa, Homo Sapiens
RSNPTKTKK

SEQ ID NO: 1405704 - protein, 9 aa, Homo Sapiens
TPPRPCSSP

SEQ ID NO: 1405705 - protein, 9 aa, Homo Sapiens
YHNLYVKRH

SEQ ID NO: 1405706 - protein, 9 aa, Homo Sapiens
SPTSEPTPR

SEQ ID NO: 1405707 - protein, 9 aa, Homo Sapiens
SLLQDIVVS

SEQ ID NO: 1405708 - protein, 9 aa, Homo Sapiens
NVSYICSRH

SEQ ID NO: 1405709 - protein, 9 aa, Homo Sapiens
SSRGDTGAR

SEQ ID NO: 1405710 - protein, 9 aa, Homo Sapiens
RPKRKYKPK

SEQ ID NO: 1405711 - protein, 9 aa, Homo Sapiens
RSSLMRQVF

SEQ ID NO: 1405712 - protein, 9 aa, Homo Sapiens
IVEVSVETI

SEQ ID NO: 1405713 - protein, 9 aa, Homo Sapiens
PCSSPSPSP

SEQ ID NO: 1405714 - protein, 9 aa, Homo Sapiens
YLLITGPNG

SEQ ID NO: 1405715 - protein, 9 aa, Homo Sapiens
SLGEKPQIF

SEQ ID NO: 1405716 - protein, 9 aa, Homo Sapiens
SSQVEEGPS

SEQ ID NO: 1405717 - protein, 9 aa, Homo Sapiens
AYQQGQKQL

SEQ ID NO: 1405718 - protein, 9 aa, Homo Sapiens
RLEGGVQVL

SEQ ID NO: 1405719 - protein, 9 aa, Homo Sapiens
VKCPHIQKE

SEQ ID NO: 1405720 - protein, 9 aa, Homo Sapiens
IRVRNGNRQ

SEQ ID NO: 1405721 - protein, 9 aa, Homo Sapiens
NVSKISFFV

SEQ ID NO: 1405722 - protein, 9 aa, Homo Sapiens
SISRPTSRA

SEQ ID NO: 1405723 - protein, 9 aa, Homo Sapiens
NPEHHPGVT

SEQ ID NO: 1405724 - protein, 9 aa, Homo Sapiens
SRAPASPGR

SEQ ID NO: 1405725 - protein, 9 aa, Homo Sapiens
ECSECGWIF

SEQ ID NO: 1405726 - protein, 9 aa, Homo Sapiens
LLEVNENRV

SEQ ID NO: 1405727 - protein, 9 aa, Homo Sapiens
VVNRINEPL

SEQ ID NO: 1405728 - protein, 9 aa, Homo Sapiens
VAPRGLLCP

SEQ ID NO: 1405729 - protein, 9 aa, Homo Sapiens
APPASWAPQ

SEQ ID NO: 1405730 - protein, 9 aa, Homo Sapiens
GVGGGAGVL

SEQ ID NO: 1405731 - protein, 9 aa, Homo Sapiens
EVNNFPQKI

SEQ ID NO: 1405732 - protein, 9 aa, Homo Sapiens
LLDICFTIS

SEQ ID NO: 1405733 - protein, 9 aa, Homo Sapiens
VPALRLPAK

SEQ ID NO: 1405734 - protein, 9 aa, Homo Sapiens
ISYLITTGI

SEQ ID NO: 1405735 - protein, 9 aa, Homo Sapiens
LLASEDRRE

SEQ ID NO: 1405736 - protein, 9 aa, Homo Sapiens
HICGAVHGQ

SEQ ID NO: 1405737 - protein, 9 aa, Homo Sapiens
TFHRCRFCS

SEQ ID NO: 1405738 - protein, 9 aa, Homo Sapiens
LLALPITVL

SEQ ID NO: 1405739 - protein, 9 aa, Homo Sapiens
ASEDIHKTF

SEQ ID NO: 1405740 - protein, 9 aa, Homo Sapiens
GASMTISRG

SEQ ID NO: 1405741 - protein, 9 aa, Homo Sapiens
ADFTLLRCL

SEQ ID NO: 1405742 - protein, 9 aa, Homo Sapiens
CSDMATTFN

SEQ ID NO: 1405743 - protein, 9 aa, Homo Sapiens
VWVNYDFGP

SEQ ID NO: 1405744 - protein, 9 aa, Homo Sapiens
AGSKGSGEG

SEQ ID NO: 1405745 - protein, 9 aa, Homo Sapiens
ENPHGTLPS

SEQ ID NO: 1405746 - protein, 9 aa, Homo Sapiens
WKSALANLK

SEQ ID NO: 1405747 - protein, 9 aa, Homo Sapiens
ETLRVLRLI

SEQ ID NO: 1405748 - protein, 9 aa, Homo Sapiens
EVNPFENKN

SEQ ID NO: 1405749 - protein, 9 aa, Homo Sapiens
QKNRILKQM

SEQ ID NO: 1405750 - protein, 9 aa, Homo Sapiens
DVILTHNGT

SEQ ID NO: 1405751 - protein, 9 aa, Homo Sapiens
WAPQMRAAP

SEQ ID NO: 1405752 - protein, 9 aa, Homo Sapiens
LILWPQAAP

SEQ ID NO: 1405753 - protein, 9 aa, Homo Sapiens
RPPPLVRCH

SEQ ID NO: 1405754 - protein, 9 aa, Homo Sapiens
SPQDTEIID

SEQ ID NO: 1405755 - protein, 9 aa, Homo Sapiens
QLMWLYLDH

SEQ ID NO: 1405756 - protein, 9 aa, Homo Sapiens
KRVFDLEWQ

SEQ ID NO: 1405757 - protein, 9 aa, Homo Sapiens
AGIKVHDIR

SEQ ID NO: 1405758 - protein, 9 aa, Homo Sapiens
MASLKKNNI

SEQ ID NO: 1405759 - protein, 9 aa, Homo Sapiens
DVDSSPKGS

SEQ ID NO: 1405760 - protein, 9 aa, Homo Sapiens
TNIDLSDKT

SEQ ID NO: 1405761 - protein, 9 aa, Homo Sapiens
ISKKTPFLN

SEQ ID NO: 1405762 - protein, 9 aa, Homo Sapiens
TVLAVAATH

SEQ ID NO: 1405763 - protein, 9 aa, Homo Sapiens
YCFMAVTSS

SEQ ID NO: 1405764 - protein, 9 aa, Homo Sapiens
FGTKVPALR

SEQ ID NO: 1405765 - protein, 9 aa, Homo Sapiens
RFVIWGSLA

SEQ ID NO: 1405766 - protein, 9 aa, Homo Sapiens
TVRKQTLNF

SEQ ID NO: 1405767 - protein, 9 aa, Homo Sapiens
AACSVTYSA

SEQ ID NO: 1405768 - protein, 9 aa, Homo Sapiens
SDMATTFNG

SEQ ID NO: 1405769 - protein, 9 aa, Homo Sapiens
STQKRYIFT

SEQ ID NO: 1405770 - protein, 9 aa, Homo Sapiens
VQSCSQVGG

SEQ ID NO: 1405771 - protein, 9 aa, Homo Sapiens
VAPEFRCLG

SEQ ID NO: 1405772 - protein, 9 aa, Homo Sapiens
SSSITSSIH

SEQ ID NO: 1405773 - protein, 9 aa, Homo Sapiens
AKAVTRAKQ

SEQ ID NO: 1405774 - protein, 9 aa, Homo Sapiens
SPKIAFKGI

SEQ ID NO: 1405775 - protein, 9 aa, Homo Sapiens
AAPKNRHTI

SEQ ID NO: 1405776 - protein, 9 aa, Homo Sapiens
FFVMFLMYL

SEQ ID NO: 1405777 - protein, 9 aa, Homo Sapiens
WQDNERVLF

SEQ ID NO: 1405778 - protein, 9 aa, Homo Sapiens
AKSTYLHKL

SEQ ID NO: 1405779 - protein, 9 aa, Homo Sapiens
LQDIVVSGY

SEQ ID NO: 1405780 - protein, 9 aa, Homo Sapiens
PKIAFKGIA

SEQ ID NO: 1405781 - protein, 9 aa, Homo Sapiens
PPGHHDPPP

SEQ ID NO: 1405782 - protein, 9 aa, Homo Sapiens
ADSLAVAKL

SEQ ID NO: 1405783 - protein, 9 aa, Homo Sapiens
CEAETLRVL

SEQ ID NO: 1405784 - protein, 9 aa, Homo Sapiens
GVQVLDLHH

SEQ ID NO: 1405785 - protein, 9 aa, Homo Sapiens
GYEFQGEER

SEQ ID NO: 1405786 - protein, 9 aa, Homo Sapiens
VLDLHHGLG

SEQ ID NO: 1405787 - protein, 9 aa, Homo Sapiens
RARQSCCLP

SEQ ID NO: 1405788 - protein, 9 aa, Homo Sapiens
KCPHIQKET

SEQ ID NO: 1405789 - protein, 9 aa, Homo Sapiens
KWECKAYLP

SEQ ID NO: 1405790 - protein, 9 aa, Homo Sapiens
CSCIEGVDF

SEQ ID NO: 1405791 - protein, 9 aa, Homo Sapiens
LADLGFLST

SEQ ID NO: 1405792 - protein, 9 aa, Homo Sapiens
GMLLDYFHH

SEQ ID NO: 1405793 - protein, 9 aa, Homo Sapiens
FSHVTLHAT

SEQ ID NO: 1405794 - protein, 9 aa, Homo Sapiens
SLYIHFKKH

SEQ ID NO: 1405795 - protein, 9 aa, Homo Sapiens
LGAFSHVTL

SEQ ID NO: 1405796 - protein, 9 aa, Homo Sapiens
GVITPMMNP

SEQ ID NO: 1405797 - protein, 9 aa, Homo Sapiens
KGASMTISR

SEQ ID NO: 1405798 - protein, 9 aa, Homo Sapiens
TEDLKTEID

SEQ ID NO: 1405799 - protein, 9 aa, Homo Sapiens
YGKSFVHSS

SEQ ID NO: 1405800 - protein, 9 aa, Homo Sapiens
SWTMTFEER

SEQ ID NO: 1405801 - protein, 9 aa, Homo Sapiens
HDTERLDDF

SEQ ID NO: 1405802 - protein, 9 aa, Homo Sapiens
TGQHMTFPP

SEQ ID NO: 1405803 - protein, 9 aa, Homo Sapiens
DVGMAGAAI

SEQ ID NO: 1405804 - protein, 9 aa, Homo Sapiens
NHSLQAKST

SEQ ID NO: 1405805 - protein, 9 aa, Homo Sapiens
ITGQHMTFP

SEQ ID NO: 1405806 - protein, 9 aa, Homo Sapiens
ASGHIKRPK

SEQ ID NO: 1405807 - protein, 9 aa, Homo Sapiens
ASSRPKRKY

SEQ ID NO: 1405808 - protein, 9 aa, Homo Sapiens
IAFKGIAQR

SEQ ID NO: 1405809 - protein, 9 aa, Homo Sapiens
ALHLVKPRV

SEQ ID NO: 1405810 - protein, 9 aa, Homo Sapiens
IEDADPYHA

SEQ ID NO: 1405811 - protein, 9 aa, Homo Sapiens
LQRSSLMRQ

SEQ ID NO: 1405812 - protein, 9 aa, Homo Sapiens
RFETLQLSF

SEQ ID NO: 1405813 - protein, 9 aa, Homo Sapiens
QLTTMCEDF

SEQ ID NO: 1405814 - protein, 9 aa, Homo Sapiens
QHQPWPSTS

SEQ ID NO: 1405815 - protein, 9 aa, Homo Sapiens
LGRLEGGVQ

SEQ ID NO: 1405816 - protein, 9 aa, Homo Sapiens
HKTFEINQK

SEQ ID NO: 1405817 - protein, 9 aa, Homo Sapiens
SPPPKIERN

SEQ ID NO: 1405818 - protein, 9 aa, Homo Sapiens
DKQGFHMKQ

SEQ ID NO: 1405819 - protein, 9 aa, Homo Sapiens
FAYEDTKTL

SEQ ID NO: 1405820 - protein, 9 aa, Homo Sapiens
ALNFEDFKN

SEQ ID NO: 1405821 - protein, 9 aa, Homo Sapiens
ETTVVRHDL

SEQ ID NO: 1405822 - protein, 9 aa, Homo Sapiens
DICFTISLA

SEQ ID NO: 1405823 - protein, 9 aa, Homo Sapiens
CRFCSQLLT

SEQ ID NO: 1405824 - protein, 9 aa, Homo Sapiens
LDSYPVVNR

SEQ ID NO: 1405825 - protein, 9 aa, Homo Sapiens
AGVPYSVLE

SEQ ID NO: 1405826 - protein, 9 aa, Homo Sapiens
IVEAHLKEL

SEQ ID NO: 1405827 - protein, 9 aa, Homo Sapiens
CWGLVLPTC

SEQ ID NO: 1405828 - protein, 9 aa, Homo Sapiens
ECKAYLPWS

SEQ ID NO: 1405829 - protein, 9 aa, Homo Sapiens
TSRSCMTSQ

SEQ ID NO: 1405830 - protein, 9 aa, Homo Sapiens
QARAACGPC

SEQ ID NO: 1405831 - protein, 9 aa, Homo Sapiens
QRTEDLKTE

SEQ ID NO: 1405832 - protein, 9 aa, Homo Sapiens
CSRQRQILH

SEQ ID NO: 1405833 - protein, 9 aa, Homo Sapiens
GLGLLGIIS

SEQ ID NO: 1405834 - protein, 9 aa, Homo Sapiens
GHTRKRPYL

SEQ ID NO: 1405835 - protein, 9 aa, Homo Sapiens
QPHLCRELH

SEQ ID NO: 1405836 - protein, 9 aa, Homo Sapiens
CSLTWSPLL

SEQ ID NO: 1405837 - protein, 9 aa, Homo Sapiens
FNREKLPLT

SEQ ID NO: 1405838 - protein, 9 aa, Homo Sapiens
PALRLPAKD

SEQ ID NO: 1405839 - protein, 9 aa, Homo Sapiens
SSIHDTERL

SEQ ID NO: 1405840 - protein, 9 aa, Homo Sapiens
NEGSSSQVE

SEQ ID NO: 1405841 - protein, 9 aa, Homo Sapiens
RGLLCPALH

SEQ ID NO: 1405842 - protein, 9 aa, Homo Sapiens
VLMVDEDVT

SEQ ID NO: 1405843 - protein, 9 aa, Homo Sapiens
VTSSCSLQC

SEQ ID NO: 1405844 - protein, 9 aa, Homo Sapiens
TSQHQPWPS

SEQ ID NO: 1405845 - protein, 9 aa, Homo Sapiens
LTIFANWRG

SEQ ID NO: 1405846 - protein, 9 aa, Homo Sapiens
ADLGFLSTL

SEQ ID NO: 1405847 - protein, 9 aa, Homo Sapiens
DADFTLLRC

SEQ ID NO: 1405848 - protein, 9 aa, Homo Sapiens
NVDHTSVLA

SEQ ID NO: 1405849 - protein, 9 aa, Homo Sapiens
DVAGVPYSV

SEQ ID NO: 1405850 - protein, 9 aa, Homo Sapiens
APPVSNQPV

SEQ ID NO: 1405851 - protein, 9 aa, Homo Sapiens
LLIILAIRI

SEQ ID NO: 1405852 - protein, 9 aa, Homo Sapiens
RENPHGTLP

SEQ ID NO: 1405853 - protein, 9 aa, Homo Sapiens
EWSARSESA

SEQ ID NO: 1405854 - protein, 9 aa, Homo Sapiens
TSSLIGINT

SEQ ID NO: 1405855 - protein, 9 aa, Homo Sapiens
DFTLLRCLS

SEQ ID NO: 1405856 - protein, 9 aa, Homo Sapiens
HIFRHQKLH

SEQ ID NO: 1405857 - protein, 9 aa, Homo Sapiens
GSSSQVEEG

SEQ ID NO: 1405858 - protein, 9 aa, Homo Sapiens
CAPKERPLG

SEQ ID NO: 1405859 - protein, 9 aa, Homo Sapiens
HHQLSDPNH

SEQ ID NO: 1405860 - protein, 9 aa, Homo Sapiens
TSSIHDTER

SEQ ID NO: 1405861 - protein, 9 aa, Homo Sapiens
FICTNRKAL

SEQ ID NO: 1405862 - protein, 9 aa, Homo Sapiens
GLLGIISVE

SEQ ID NO: 1405863 - protein, 9 aa, Homo Sapiens
ITHHVVILF

SEQ ID NO: 1405864 - protein, 9 aa, Homo Sapiens
IAVRHEPTL

SEQ ID NO: 1405865 - protein, 9 aa, Homo Sapiens
ACAPKERPL

SEQ ID NO: 1405866 - protein, 9 aa, Homo Sapiens
HWRIGGGTP

SEQ ID NO: 1405867 - protein, 9 aa, Homo Sapiens
VVHEFGHVI

SEQ ID NO: 1405868 - protein, 9 aa, Homo Sapiens
SCMTSQPEM

SEQ ID NO: 1405869 - protein, 9 aa, Homo Sapiens
LELPSQSRC

SEQ ID NO: 1405870 - protein, 9 aa, Homo Sapiens
SNKPYECKR

SEQ ID NO: 1405871 - protein, 9 aa, Homo Sapiens
GRTLIVEVS

SEQ ID NO: 1405872 - protein, 9 aa, Homo Sapiens
QQVHKATAE

SEQ ID NO: 1405873 - protein, 9 aa, Homo Sapiens
TYSPQDTEI

SEQ ID NO: 1405874 - protein, 9 aa, Homo Sapiens
ALYSVPFWK

SEQ ID NO: 1405875 - protein, 9 aa, Homo Sapiens
PHILTGATS

SEQ ID NO: 1405876 - protein, 9 aa, Homo Sapiens
KREDAMKEF

SEQ ID NO: 1405877 - protein, 9 aa, Homo Sapiens
NDINDNPPV

SEQ ID NO: 1405878 - protein, 9 aa, Homo Sapiens
LPGPCASLL

SEQ ID NO: 1405879 - protein, 9 aa, Homo Sapiens
ITTGIRKVC

SEQ ID NO: 1405880 - protein, 9 aa, Homo Sapiens
DVSDNAPLT

SEQ ID NO: 1405881 - protein, 9 aa, Homo Sapiens
PSLHHQLSD

SEQ ID NO: 1405882 - protein, 9 aa, Homo Sapiens
TEIIDTKLK

SEQ ID NO: 1405883 - protein, 9 aa, Homo Sapiens
MVAGLFHDT

SEQ ID NO: 1405884 - protein, 9 aa, Homo Sapiens
WINRFVIWG

SEQ ID NO: 1405885 - protein, 9 aa, Homo Sapiens
FGHVIGFWH

SEQ ID NO: 1405886 - protein, 9 aa, Homo Sapiens
VVRRCRHHE

SEQ ID NO: 1405887 - protein, 9 aa, Homo Sapiens
FDINLKERF

SEQ ID NO: 1405888 - protein, 9 aa, Homo Sapiens
EELRTVVEK

SEQ ID NO: 1405889 - protein, 9 aa, Homo Sapiens
RHTIEVNRC

SEQ ID NO: 1405890 - protein, 9 aa, Homo Sapiens
ERPLGRKPC

SEQ ID NO: 1405891 - protein, 9 aa, Homo Sapiens
ETGSVHAAS

SEQ ID NO: 1405892 - protein, 9 aa, Homo Sapiens
LHERYYDIT

SEQ ID NO: 1405893 - protein, 9 aa, Homo Sapiens
TVLCTFMSL

SEQ ID NO: 1405894 - protein, 9 aa, Homo Sapiens
ADHGKSHVF

SEQ ID NO: 1405895 - protein, 9 aa, Homo Sapiens
PPKIRMYSL

SEQ ID NO: 1405896 - protein, 9 aa, Homo Sapiens
HPPMPPSAL

SEQ ID NO: 1405897 - protein, 9 aa, Homo Sapiens
IMLEEPSIT

SEQ ID NO: 1405898 - protein, 9 aa, Homo Sapiens
LRMVEIGDE

SEQ ID NO: 1405899 - protein, 9 aa, Homo Sapiens
PKTYIWQDN

SEQ ID NO: 1405900 - protein, 9 aa, Homo Sapiens
QPSLPGPCA

SEQ ID NO: 1405901 - protein, 9 aa, Homo Sapiens
GQPSLHHQL

SEQ ID NO: 1405902 - protein, 9 aa, Homo Sapiens
PQSTKRKNM

SEQ ID NO: 1405903 - protein, 9 aa, Homo Sapiens
FSIVADHGK

SEQ ID NO: 1405904 - protein, 9 aa, Homo Sapiens
VVILFVLVP

SEQ ID NO: 1405905 - protein, 9 aa, Homo Sapiens
RKQEEKMET

SEQ ID NO: 1405906 - protein, 9 aa, Homo Sapiens
LKKNNIPNK

SEQ ID NO: 1405907 - protein, 9 aa, Homo Sapiens
NVTASTHRP

SEQ ID NO: 1405908 - protein, 9 aa, Homo Sapiens
KTARCPGHA

SEQ ID NO: 1405909 - protein, 9 aa, Homo Sapiens
SSIRSLPPT

SEQ ID NO: 1405910 - protein, 9 aa, Homo Sapiens
LRCLSLENR

SEQ ID NO: 1405911 - protein, 9 aa, Homo Sapiens
RFVRKKVIT

SEQ ID NO: 1405912 - protein, 9 aa, Homo Sapiens
YRATICAKR

SEQ ID NO: 1405913 - protein, 9 aa, Homo Sapiens
TDIKWIKKD

SEQ ID NO: 1405914 - protein, 9 aa, Homo Sapiens
EDDGDEEEE

SEQ ID NO: 1405915 - protein, 9 aa, Homo Sapiens
CISQTEGDL

SEQ ID NO: 1405916 - protein, 9 aa, Homo Sapiens
AMFGGHLWR

SEQ ID NO: 1405917 - protein, 9 aa, Homo Sapiens
TYIWQDNER

SEQ ID NO: 1405918 - protein, 9 aa, Homo Sapiens
AAVHSPWPH

SEQ ID NO: 1405919 - protein, 9 aa, Homo Sapiens
CYLLSVMVY

SEQ ID NO: 1405920 - protein, 9 aa, Homo Sapiens
SLQCSVAWG

SEQ ID NO: 1405921 - protein, 9 aa, Homo Sapiens
CWNTSTPAC

SEQ ID NO: 1405922 - protein, 9 aa, Homo Sapiens
PKREDAMKE

SEQ ID NO: 1405923 - protein, 9 aa, Homo Sapiens
ASFQEEIVQ

SEQ ID NO: 1405924 - protein, 9 aa, Homo Sapiens
VHGQQSLPG

SEQ ID NO: 1405925 - protein, 9 aa, Homo Sapiens
EPVHNLLPV

SEQ ID NO: 1405926 - protein, 9 aa, Homo Sapiens
CEEAGVKGK

SEQ ID NO: 1405927 - protein, 9 aa, Homo Sapiens
QEKSQGALE

SEQ ID NO: 1405928 - protein, 9 aa, Homo Sapiens
IRGRACFCA

SEQ ID NO: 1405929 - protein, 9 aa, Homo Sapiens
VFDLEWQNQ

SEQ ID NO: 1405930 - protein, 9 aa, Homo Sapiens
LMGGMSRTP

SEQ ID NO: 1405931 - protein, 9 aa, Homo Sapiens
ELRKIHQLE

SEQ ID NO: 1405932 - protein, 9 aa, Homo Sapiens
KERRIKNPE

SEQ ID NO: 1405933 - protein, 9 aa, Homo Sapiens
KKTPFLNSQ

SEQ ID NO: 1405934 - protein, 9 aa, Homo Sapiens
SNTSSLIGI

SEQ ID NO: 1405935 - protein, 9 aa, Homo Sapiens
GTPLSISRP

SEQ ID NO: 1405936 - protein, 9 aa, Homo Sapiens
VMLIFPVTV

SEQ ID NO: 1405937 - protein, 9 aa, Homo Sapiens
VEWSARSES

SEQ ID NO: 1405938 - protein, 9 aa, Homo Sapiens
LEGGVQVLD

SEQ ID NO: 1405939 - protein, 9 aa, Homo Sapiens
ITVLCTFMS

SEQ ID NO: 1405940 - protein, 9 aa, Homo Sapiens
NSSWTMTFE

SEQ ID NO: 1405941 - protein, 9 aa, Homo Sapiens
KYAKAVTRA

SEQ ID NO: 1405942 - protein, 9 aa, Homo Sapiens
TAEKFKVPS

SEQ ID NO: 1405943 - protein, 9 aa, Homo Sapiens
LKISMPEVD

SEQ ID NO: 1405944 - protein, 9 aa, Homo Sapiens
ELALVIFSV

SEQ ID NO: 1405945 - protein, 9 aa, Homo Sapiens
CYESYTLNA

SEQ ID NO: 1405946 - protein, 9 aa, Homo Sapiens
KCGKAFTDR

SEQ ID NO: 1405947 - protein, 9 aa, Homo Sapiens
TSPLTVEWS

SEQ ID NO: 1405948 - protein, 9 aa, Homo Sapiens
LRRRPQPNK

SEQ ID NO: 1405949 - protein, 9 aa, Homo Sapiens
GAVVLQVGD

SEQ ID NO: 1405950 - protein, 9 aa, Homo Sapiens
EENNGQQSQ

SEQ ID NO: 1405951 - protein, 9 aa, Homo Sapiens
SLLDICFTI

SEQ ID NO: 1405952 - protein, 9 aa, Homo Sapiens
LVTPPRPCS

SEQ ID NO: 1405953 - protein, 9 aa, Homo Sapiens
VYDRFVAIS

SEQ ID NO: 1405954 - protein, 9 aa, Homo Sapiens
GLRLLRVLQ

SEQ ID NO: 1405955 - protein, 9 aa, Homo Sapiens
WSTSKHWNE

SEQ ID NO: 1405956 - protein, 9 aa, Homo Sapiens
SLKLCIYFL

SEQ ID NO: 1405957 - protein, 9 aa, Homo Sapiens
VAGVPYSVL

SEQ ID NO: 1405958 - protein, 9 aa, Homo Sapiens
HILTGATSQ

SEQ ID NO: 1405959 - protein, 9 aa, Homo Sapiens
GTYSPQDTE

SEQ ID NO: 1405960 - protein, 9 aa, Homo Sapiens
SDLNSEQMK

SEQ ID NO: 1405961 - protein, 9 aa, Homo Sapiens
AFHHTVRKQ

SEQ ID NO: 1405962 - protein, 9 aa, Homo Sapiens
SARSESAQS

SEQ ID NO: 1405963 - protein, 9 aa, Homo Sapiens
RDTEGGWHL

SEQ ID NO: 1405964 - protein, 9 aa, Homo Sapiens
YGYYPCFWG

SEQ ID NO: 1405965 - protein, 9 aa, Homo Sapiens
SRARQSCCL

SEQ ID NO: 1405966 - protein, 9 aa, Homo Sapiens
VNRRIMETA

SEQ ID NO: 1405967 - protein, 9 aa, Homo Sapiens
NGNRQWSTS

SEQ ID NO: 1405968 - protein, 9 aa, Homo Sapiens
KRKQEEKME

SEQ ID NO: 1405969 - protein, 9 aa, Homo Sapiens
MLEEPSITS

SEQ ID NO: 1405970 - protein, 9 aa, Homo Sapiens
GITVFGKRI

SEQ ID NO: 1405971 - protein, 9 aa, Homo Sapiens
PLPNVWVNY

SEQ ID NO: 1405972 - protein, 9 aa, Homo Sapiens
TNIYMADNV

SEQ ID NO: 1405973 - protein, 9 aa, Homo Sapiens
KRLCTVWDP

SEQ ID NO: 1405974 - protein, 9 aa, Homo Sapiens
IICVADQCH

SEQ ID NO: 1405975 - protein, 9 aa, Homo Sapiens
RPRPIRPPF

SEQ ID NO: 1405976 - protein, 9 aa, Homo Sapiens
INRFVIWGS

SEQ ID NO: 1405977 - protein, 9 aa, Homo Sapiens
PKIRMYSLR

SEQ ID NO: 1405978 - protein, 9 aa, Homo Sapiens
TKMATIATD

SEQ ID NO: 1405979 - protein, 9 aa, Homo Sapiens
AFTAHQTHL

SEQ ID NO: 1405980 - protein, 9 aa, Homo Sapiens
CMTSQPEMP

SEQ ID NO: 1405981 - protein, 9 aa, Homo Sapiens
STNLKTLNQ

SEQ ID NO: 1405982 - protein, 9 aa, Homo Sapiens
SSLPVEGTS

SEQ ID NO: 1405983 - protein, 9 aa, Homo Sapiens
EAKKRRKVY

SEQ ID NO: 1405984 - protein, 9 aa, Homo Sapiens
GWDDDEDDG

SEQ ID NO: 1405985 - protein, 9 aa, Homo Sapiens
RLSASQIWN

SEQ ID NO: 1405986 - protein, 9 aa, Homo Sapiens
DVSESPELH

SEQ ID NO: 1405987 - protein, 9 aa, Homo Sapiens
LPAPEIRLS

SEQ ID NO: 1405988 - protein, 9 aa, Homo Sapiens
AHQTHLASK

SEQ ID NO: 1405989 - protein, 9 aa, Homo Sapiens
PRACAPKER

SEQ ID NO: 1405990 - protein, 9 aa, Homo Sapiens
VEGTSPPSS

SEQ ID NO: 1405991 - protein, 9 aa, Homo Sapiens
FETLQLSFK

SEQ ID NO: 1405992 - protein, 9 aa, Homo Sapiens
QPNKSAVIP

SEQ ID NO: 1405993 - protein, 9 aa, Homo Sapiens
FKGICQRDV

SEQ ID NO: 1405994 - protein, 9 aa, Homo Sapiens
VTLQAAARE

SEQ ID NO: 1405995 - protein, 9 aa, Homo Sapiens
VPAGKGVGG

SEQ ID NO: 1405996 - protein, 9 aa, Homo Sapiens
DPPPMDQYL

SEQ ID NO: 1405997 - protein, 9 aa, Homo Sapiens
HGNLLVSAS

SEQ ID NO: 1405998 - protein, 9 aa, Homo Sapiens
RQSCCLPGL

SEQ ID NO: 1405999 - protein, 9 aa, Homo Sapiens
LLRCLSLEN

SEQ ID NO: 1406000 - protein, 9 aa, Homo Sapiens
QSRVTNQTL

SEQ ID NO: 1406001 - protein, 9 aa, Homo Sapiens
SRPTSRARQ

SEQ ID NO: 1406002 - protein, 9 aa, Homo Sapiens
RMAPPASWA

SEQ ID NO: 1406003 - protein, 9 aa, Homo Sapiens
CITLENSFV

SEQ ID NO: 1406004 - protein, 9 aa, Homo Sapiens
VPPLPNVWV

SEQ ID NO: 1406005 - protein, 9 aa, Homo Sapiens
YNLPMHKTI

SEQ ID NO: 1406006 - protein, 9 aa, Homo Sapiens
QAINDGSPV

SEQ ID NO: 1406007 - protein, 9 aa, Homo Sapiens
IRLSSCCLL

SEQ ID NO: 1406008 - protein, 9 aa, Homo Sapiens
DLGFLSTLA

SEQ ID NO: 1406009 - protein, 9 aa, Homo Sapiens
TAHQTHLAS

SEQ ID NO: 1406010 - protein, 9 aa, Homo Sapiens
QGFHMKQGV

SEQ ID NO: 1406011 - protein, 9 aa, Homo Sapiens
AAACSVTYS

SEQ ID NO: 1406012 - protein, 9 aa, Homo Sapiens
VTPPRPCSS

SEQ ID NO: 1406013 - protein, 9 aa, Homo Sapiens
RCLSLENRG

SEQ ID NO: 1406014 - protein, 9 aa, Homo Sapiens
RPSSLPVEG

SEQ ID NO: 1406015 - protein, 9 aa, Homo Sapiens
ESHHRAKGK

SEQ ID NO: 1406016 - protein, 9 aa, Homo Sapiens
ELRTVVEKL

SEQ ID NO: 1406017 - protein, 9 aa, Homo Sapiens
ATICAKRKL

SEQ ID NO: 1406018 - protein, 9 aa, Homo Sapiens
LPTCLLASW

SEQ ID NO: 1406019 - protein, 9 aa, Homo Sapiens
GQMENTNNY

SEQ ID NO: 1406020 - protein, 9 aa, Homo Sapiens
FWGSDNRLA

SEQ ID NO: 1406021 - protein, 9 aa, Homo Sapiens
LSQPPPQAP

SEQ ID NO: 1406022 - protein, 9 aa, Homo Sapiens
GAAKNTRAQ

SEQ ID NO: 1406023 - protein, 9 aa, Homo Sapiens
KALKISMPE

SEQ ID NO: 1406024 - protein, 9 aa, Homo Sapiens
MAGAAIDTV

SEQ ID NO: 1406025 - protein, 9 aa, Homo Sapiens
KIKELRKIH

SEQ ID NO: 1406026 - protein, 9 aa, Homo Sapiens
DDGDEEEED

SEQ ID NO: 1406027 - protein, 9 aa, Homo Sapiens
FHMKQGVLT

SEQ ID NO: 1406028 - protein, 9 aa, Homo Sapiens
HQPWPSTSR

SEQ ID NO: 1406029 - protein, 9 aa, Homo Sapiens
PYCFSIVAD

SEQ ID NO: 1406030 - protein, 9 aa, Homo Sapiens
TALSFSGPR

SEQ ID NO: 1406031 - protein, 9 aa, Homo Sapiens
RPCSSPSPS

SEQ ID NO: 1406032 - protein, 9 aa, Homo Sapiens
QAPSQVWTA

SEQ ID NO: 1406033 - protein, 9 aa, Homo Sapiens
EKIKELRKI

SEQ ID NO: 1406034 - protein, 9 aa, Homo Sapiens
QWSTSKHWN

SEQ ID NO: 1406035 - protein, 9 aa, Homo Sapiens
CFWGSDNRL

SEQ ID NO: 1406036 - protein, 9 aa, Homo Sapiens
INLKERFVR

SEQ ID NO: 1406037 - protein, 9 aa, Homo Sapiens
NSSIQIHHY

SEQ ID NO: 1406038 - protein, 9 aa, Homo Sapiens
AEKDQYWNE

SEQ ID NO: 1406039 - protein, 9 aa, Homo Sapiens
WNEDQPQPP

SEQ ID NO: 1406040 - protein, 9 aa, Homo Sapiens
PLLEQLKKK

SEQ ID NO: 1406041 - protein, 9 aa, Homo Sapiens
KRKYKPKPR

SEQ ID NO: 1406042 - protein, 9 aa, Homo Sapiens
SSPKIAFKG

SEQ ID NO: 1406043 - protein, 9 aa, Homo Sapiens
KRPYLCWEC

SEQ ID NO: 1406044 - protein, 9 aa, Homo Sapiens
LTAAFFLTT

SEQ ID NO: 1406045 - protein, 9 aa, Homo Sapiens
FYGVITPMM

SEQ ID NO: 1406046 - protein, 9 aa, Homo Sapiens
RPDLDKTKN

SEQ ID NO: 1406047 - protein, 9 aa, Homo Sapiens
SCNTLTCRD

SEQ ID NO: 1406048 - protein, 9 aa, Homo Sapiens
VHAASVAAS

SEQ ID NO: 1406049 - protein, 9 aa, Homo Sapiens
ETLQLSFKN

SEQ ID NO: 1406050 - protein, 9 aa, Homo Sapiens
EAETLRVLR

SEQ ID NO: 1406051 - protein, 9 aa, Homo Sapiens
LTINGSNLP

SEQ ID NO: 1406052 - protein, 9 aa, Homo Sapiens
EKDQYWNED

SEQ ID NO: 1406053 - protein, 9 aa, Homo Sapiens
SERNNPDVS

SEQ ID NO: 1406054 - protein, 9 aa, Homo Sapiens
PPDIRGRAC

SEQ ID NO: 1406055 - protein, 9 aa, Homo Sapiens
NLLPVLMVD

SEQ ID NO: 1406056 - protein, 9 aa, Homo Sapiens
ARSSLYIHF

SEQ ID NO: 1406057 - protein, 9 aa, Homo Sapiens
RSLPPTVTS

SEQ ID NO: 1406058 - protein, 9 aa, Homo Sapiens
DQRTEDLKT

SEQ ID NO: 1406059 - protein, 9 aa, Homo Sapiens
RTSGARFCR

SEQ ID NO: 1406060 - protein, 9 aa, Homo Sapiens
STGPGWEEP

SEQ ID NO: 1406061 - protein, 9 aa, Homo Sapiens
DSVNRRIME

SEQ ID NO: 1406062 - protein, 9 aa, Homo Sapiens
QSTLSFCQH

SEQ ID NO: 1406063 - protein, 9 aa, Homo Sapiens
RKRPYLCWE

SEQ ID NO: 1406064 - protein, 9 aa, Homo Sapiens
SSSPKIAFK

SEQ ID NO: 1406065 - protein, 9 aa, Homo Sapiens
RCRFCSQLL

SEQ ID NO: 1406066 - protein, 9 aa, Homo Sapiens
AQLMTKNPL

SEQ ID NO: 1406067 - protein, 9 aa, Homo Sapiens
VSLLLKEKQ

SEQ ID NO: 1406068 - protein, 9 aa, Homo Sapiens
LPMHKTINT

SEQ ID NO: 1406069 - protein, 9 aa, Homo Sapiens
SQHQPWPST

SEQ ID NO: 1406070 - protein, 9 aa, Homo Sapiens
TTASVTLNV

SEQ ID NO: 1406071 - protein, 9 aa, Homo Sapiens
SWRMRRSRW

SEQ ID NO: 1406072 - protein, 9 aa, Homo Sapiens
LPITVLAVL

SEQ ID NO: 1406073 - protein, 9 aa, Homo Sapiens
PTGPAAPLA

SEQ ID NO: 1406074 - protein, 9 aa, Homo Sapiens
LHQNLDPTS

SEQ ID NO: 1406075 - protein, 9 aa, Homo Sapiens
CPAVPAAAC

SEQ ID NO: 1406076 - protein, 9 aa, Homo Sapiens
LPLSLYRNM

SEQ ID NO: 1406077 - protein, 9 aa, Homo Sapiens
IKIVGLRLL

SEQ ID NO: 1406078 - protein, 9 aa, Homo Sapiens
RAPPGRWCF

SEQ ID NO: 1406079 - protein, 9 aa, Homo Sapiens
FPTPLLASE

SEQ ID NO: 1406080 - protein, 9 aa, Homo Sapiens
IKNPEHHPG

SEQ ID NO: 1406081 - protein, 9 aa, Homo Sapiens
AGMPGTACG

SEQ ID NO: 1406082 - protein, 9 aa, Homo Sapiens
ETGLFLPSA

SEQ ID NO: 1406083 - protein, 9 aa, Homo Sapiens
ARFCRAGYL

SEQ ID NO: 1406084 - protein, 9 aa, Homo Sapiens
RINEPLVIF

SEQ ID NO: 1406085 - protein, 9 aa, Homo Sapiens
TAPPVSNQP

SEQ ID NO: 1406086 - protein, 9 aa, Homo Sapiens
MAVTSSCSL

SEQ ID NO: 1406087 - protein, 9 aa, Homo Sapiens
LVAPRGLLC

SEQ ID NO: 1406088 - protein, 9 aa, Homo Sapiens
AHIQQNAVQ

SEQ ID NO: 1406089 - protein, 9 aa, Homo Sapiens
PSSQECLQS

SEQ ID NO: 1406090 - protein, 9 aa, Homo Sapiens
FQEEIVQVG

SEQ ID NO: 1406091 - protein, 9 aa, Homo Sapiens
KKDTATWKD

SEQ ID NO: 1406092 - protein, 9 aa, Homo Sapiens
ARRKRIPFS

SEQ ID NO: 1406093 - protein, 9 aa, Homo Sapiens
PYLCWECGK

SEQ ID NO: 1406094 - protein, 9 aa, Homo Sapiens
FVLEMHFRW

SEQ ID NO: 1406095 - protein, 9 aa, Homo Sapiens
ELQPWCFTT

SEQ ID NO: 1406096 - protein, 9 aa, Homo Sapiens
GSVERRWEK

SEQ ID NO: 1406097 - protein, 9 aa, Homo Sapiens
PHGNLLVSA

SEQ ID NO: 1406098 - protein, 9 aa, Homo Sapiens
LEWQNQMLS

SEQ ID NO: 1406099 - protein, 9 aa, Homo Sapiens
ASVAASRVE

SEQ ID NO: 1406100 - protein, 9 aa, Homo Sapiens
VYGALPPPC

SEQ ID NO: 1406101 - protein, 9 aa, Homo Sapiens
PPCCDPSGL

SEQ ID NO: 1406102 - protein, 9 aa, Homo Sapiens
GKRILDEEV

SEQ ID NO: 1406103 - protein, 9 aa, Homo Sapiens
SLKKNNIPN

SEQ ID NO: 1406104 - protein, 9 aa, Homo Sapiens
APKERPLGR

SEQ ID NO: 1406105 - protein, 9 aa, Homo Sapiens
LTIVGNILL

SEQ ID NO: 1406106 - protein, 9 aa, Homo Sapiens
SVTYSALWS

SEQ ID NO: 1406107 - protein, 9 aa, Homo Sapiens
SGGPHLLQP

SEQ ID NO: 1406108 - protein, 9 aa, Homo Sapiens
LHPPMPPSA

SEQ ID NO: 1406109 - protein, 9 aa, Homo Sapiens
HNSSGETLE

SEQ ID NO: 1406110 - protein, 9 aa, Homo Sapiens
SPLTVEWSA

SEQ ID NO: 1406111 - protein, 9 aa, Homo Sapiens
NGITVFGKR

SEQ ID NO: 1406112 - protein, 9 aa, Homo Sapiens
DRRETGLFL

SEQ ID NO: 1406113 - protein, 9 aa, Homo Sapiens
YYDITVLCT

SEQ ID NO: 1406114 - protein, 9 aa, Homo Sapiens
MLLDYFHHW

SEQ ID NO: 1406115 - protein, 9 aa, Homo Sapiens
HVVILFVLV

SEQ ID NO: 1406116 - protein, 9 aa, Homo Sapiens
LEVNENRVS

SEQ ID NO: 1406117 - protein, 9 aa, Homo Sapiens
SITSSIHDT

SEQ ID NO: 1406118 - protein, 9 aa, Homo Sapiens
ALRLPAKDW

SEQ ID NO: 1406119 - protein, 9 aa, Homo Sapiens
SVHAASVAA

SEQ ID NO: 1406120 - protein, 9 aa, Homo Sapiens
MGHNSSGET

SEQ ID NO: 1406121 - protein, 9 aa, Homo Sapiens
AGIICVADQ

SEQ ID NO: 1406122 - protein, 9 aa, Homo Sapiens
PTEWRFQGL

SEQ ID NO: 1406123 - protein, 9 aa, Homo Sapiens
NIYMADNVN

SEQ ID NO: 1406124 - protein, 9 aa, Homo Sapiens
DKLYTCNQY

SEQ ID NO: 1406125 - protein, 9 aa, Homo Sapiens
NLDPTSSSF

SEQ ID NO: 1406126 - protein, 9 aa, Homo Sapiens
IGSSSRGDT

SEQ ID NO: 1406127 - protein, 9 aa, Homo Sapiens
NYHNLYVKR

SEQ ID NO: 1406128 - protein, 9 aa, Homo Sapiens
LRIAKGASM

SEQ ID NO: 1406129 - protein, 9 aa, Homo Sapiens
QGALEEYVR

SEQ ID NO: 1406130 - protein, 9 aa, Homo Sapiens
KQGGAAKNT

SEQ ID NO: 1406131 - protein, 9 aa, Homo Sapiens
PGTPPPLIL

SEQ ID NO: 1406132 - protein, 9 aa, Homo Sapiens
SYLITTGIR

SEQ ID NO: 1406133 - protein, 9 aa, Homo Sapiens
TARCPGHAS

SEQ ID NO: 1406134 - protein, 9 aa, Homo Sapiens
SSFSKWCRP

SEQ ID NO: 1406135 - protein, 9 aa, Homo Sapiens
PAEKDQYWN

SEQ ID NO: 1406136 - protein, 9 aa, Homo Sapiens
RFWTWINRF

SEQ ID NO: 1406137 - protein, 9 aa, Homo Sapiens
ADLGRLEGG

SEQ ID NO: 1406138 - protein, 9 aa, Homo Sapiens
FLTGTWADP

SEQ ID NO: 1406139 - protein, 9 aa, Homo Sapiens
VKPRVLHQN

SEQ ID NO: 1406140 - protein, 9 aa, Homo Sapiens
VEFVNLVPL

SEQ ID NO: 1406141 - protein, 9 aa, Homo Sapiens
LTHPAHQPL

SEQ ID NO: 1406142 - protein, 9 aa, Homo Sapiens
VHDIRLNGS

SEQ ID NO: 1406143 - protein, 9 aa, Homo Sapiens
RAACGPCWN

SEQ ID NO: 1406144 - protein, 9 aa, Homo Sapiens
YEDTKTLEG

SEQ ID NO: 1406145 - protein, 9 aa, Homo Sapiens
AQKNILLVH

SEQ ID NO: 1406146 - protein, 9 aa, Homo Sapiens
TDPELRRPR

SEQ ID NO: 1406147 - protein, 9 aa, Homo Sapiens
LLVSASRDR

SEQ ID NO: 1406148 - protein, 9 aa, Homo Sapiens
DLKTEIDKL

SEQ ID NO: 1406149 - protein, 9 aa, Homo Sapiens
SLTWSPLLQ

SEQ ID NO: 1406150 - protein, 9 aa, Homo Sapiens
CPLNPHIHL

SEQ ID NO: 1406151 - protein, 9 aa, Homo Sapiens
KRDTEGGWH

SEQ ID NO: 1406152 - protein, 9 aa, Homo Sapiens
SMASLKKNN

SEQ ID NO: 1406153 - protein, 9 aa, Homo Sapiens
ILAIRIDSH

SEQ ID NO: 1406154 - protein, 9 aa, Homo Sapiens
VARMLLEDI

SEQ ID NO: 1406155 - protein, 9 aa, Homo Sapiens
FRCLGLAAK

SEQ ID NO: 1406156 - protein, 9 aa, Homo Sapiens
QDTEIIDTK

SEQ ID NO: 1406157 - protein, 9 aa, Homo Sapiens
MVYDRFVAI

SEQ ID NO: 1406158 - protein, 9 aa, Homo Sapiens
MLNQFFLLE

SEQ ID NO: 1406159 - protein, 9 aa, Homo Sapiens
VDEDVTGAV

SEQ ID NO: 1406160 - protein, 9 aa, Homo Sapiens
KRILDEEVF

SEQ ID NO: 1406161 - protein, 9 aa, Homo Sapiens
IHLGTYGVF

SEQ ID NO: 1406162 - protein, 9 aa, Homo Sapiens
PSRAPASPG

SEQ ID NO: 1406163 - protein, 9 aa, Homo Sapiens
PQPHLCREL

SEQ ID NO: 1406164 - protein, 9 aa, Homo Sapiens
TEECITLEN

SEQ ID NO: 1406165 - protein, 9 aa, Homo Sapiens
FCQHKLPAQ

SEQ ID NO: 1406166 - protein, 9 aa, Homo Sapiens
RELHPRYLP

SEQ ID NO: 1406167 - protein, 9 aa, Homo Sapiens
ASQIWNLNP

SEQ ID NO: 1406168 - protein, 9 aa, Homo Sapiens
KALYSVPFW

SEQ ID NO: 1406169 - protein, 9 aa, Homo Sapiens
DTPRRGWPE

SEQ ID NO: 1406170 - protein, 9 aa, Homo Sapiens
IHDTERLDD

SEQ ID NO: 1406171 - protein, 9 aa, Homo Sapiens
LRLITSQVF

SEQ ID NO: 1406172 - protein, 9 aa, Homo Sapiens
KCPLNPHIH

SEQ ID NO: 1406173 - protein, 9 aa, Homo Sapiens
DNYLFFLMY

SEQ ID NO: 1406174 - protein, 9 aa, Homo Sapiens
LGLRMVEIG

SEQ ID NO: 1406175 - protein, 9 aa, Homo Sapiens
PVVNRINEP

SEQ ID NO: 1406176 - protein, 9 aa, Homo Sapiens
LVYTLTIVG

SEQ ID NO: 1406177 - protein, 9 aa, Homo Sapiens
HSPWPHKMA

SEQ ID NO: 1406178 - protein, 9 aa, Homo Sapiens
PLTAISVER

SEQ ID NO: 1406179 - protein, 9 aa, Homo Sapiens
SSKRDTEGG

SEQ ID NO: 1406180 - protein, 9 aa, Homo Sapiens
FHRCRFCSQ

SEQ ID NO: 1406181 - protein, 9 aa, Homo Sapiens
EKMETEQQN

SEQ ID NO: 1406182 - protein, 9 aa, Homo Sapiens
SQTEGDLPL

SEQ ID NO: 1406183 - protein, 9 aa, Homo Sapiens
GTLPSRAPA

SEQ ID NO: 1406184 - protein, 9 aa, Homo Sapiens
MQLMWLYLD

SEQ ID NO: 1406185 - protein, 9 aa, Homo Sapiens
WGSDNRLAH

SEQ ID NO: 1406186 - protein, 9 aa, Homo Sapiens
SIQIHHYPN

SEQ ID NO: 1406187 - protein, 9 aa, Homo Sapiens
TFEIQYKKD

SEQ ID NO: 1406188 - protein, 9 aa, Homo Sapiens
TLNETELTA

SEQ ID NO: 1406189 - protein, 9 aa, Homo Sapiens
GEIPGRIIC

SEQ ID NO: 1406190 - protein, 9 aa, Homo Sapiens
VGDLQAVGV

SEQ ID NO: 1406191 - protein, 9 aa, Homo Sapiens
IISKKTPFL

SEQ ID NO: 1406192 - protein, 9 aa, Homo Sapiens
PETGSVHAA

SEQ ID NO: 1406193 - protein, 9 aa, Homo Sapiens
AIRIDSHLH

SEQ ID NO: 1406194 - protein, 9 aa, Homo Sapiens
LALVIFSVV

SEQ ID NO: 1406195 - protein, 9 aa, Homo Sapiens
EELVYETDI

SEQ ID NO: 1406196 - protein, 9 aa, Homo Sapiens
YSVPFWKES

SEQ ID NO: 1406197 - protein, 9 aa, Homo Sapiens
TWINRFVIW

SEQ ID NO: 1406198 - protein, 9 aa, Homo Sapiens
EGVEGPHCD

SEQ ID NO: 1406199 - protein, 9 aa, Homo Sapiens
YLYSHYLPT

SEQ ID NO: 1406200 - protein, 9 aa, Homo Sapiens
NMKSEMAHI

SEQ ID NO: 1406201 - protein, 9 aa, Homo Sapiens
SVEILQSTL

SEQ ID NO: 1406202 - protein, 9 aa, Homo Sapiens
TIVNVPKKN

SEQ ID NO: 1406203 - protein, 9 aa, Homo Sapiens
PSSLPVEGT

SEQ ID NO: 1406204 - protein, 9 aa, Homo Sapiens
TGPGWEEPG

SEQ ID NO: 1406205 - protein, 9 aa, Homo Sapiens
IYCFMAVTS

SEQ ID NO: 1406206 - protein, 9 aa, Homo Sapiens
VFGKRILDE

SEQ ID NO: 1406207 - protein, 9 aa, Homo Sapiens
HCDKCTRGY

SEQ ID NO: 1406208 - protein, 9 aa, Homo Sapiens
ANEAHVSTN

SEQ ID NO: 1406209 - protein, 9 aa, Homo Sapiens
ASGQPSLHH

SEQ ID NO: 1406210 - protein, 9 aa, Homo Sapiens
SHHCECYES

SEQ ID NO: 1406211 - protein, 9 aa, Homo Sapiens
APKNRHTIE

SEQ ID NO: 1406212 - protein, 9 aa, Homo Sapiens
KVEFVNLVP

SEQ ID NO: 1406213 - protein, 9 aa, Homo Sapiens
DTPQPSLPG

SEQ ID NO: 1406214 - protein, 9 aa, Homo Sapiens
CRAGYLVYF

SEQ ID NO: 1406215 - protein, 9 aa, Homo Sapiens
YNYHSDTPT

SEQ ID NO: 1406216 - protein, 9 aa, Homo Sapiens
PDALGDVAG

SEQ ID NO: 1406217 - protein, 9 aa, Homo Sapiens
TLQEHNLDN

SEQ ID NO: 1406218 - protein, 9 aa, Homo Sapiens
DQSALYVTL

SEQ ID NO: 1406219 - protein, 9 aa, Homo Sapiens
VITAPPVSN

SEQ ID NO: 1406220 - protein, 9 aa, Homo Sapiens
ARAACGPCW

SEQ ID NO: 1406221 - protein, 9 aa, Homo Sapiens
HRPGTPPPL

SEQ ID NO: 1406222 - protein, 9 aa, Homo Sapiens
ASMTISRGC

SEQ ID NO: 1406223 - protein, 9 aa, Homo Sapiens
ECPRKNAFH

SEQ ID NO: 1406224 - protein, 9 aa, Homo Sapiens
LLASWQPGG

SEQ ID NO: 1406225 - protein, 9 aa, Homo Sapiens
MATTFNGLT

SEQ ID NO: 1406226 - protein, 9 aa, Homo Sapiens
KLCIYFLEE

SEQ ID NO: 1406227 - protein, 9 aa, Homo Sapiens
RIDSHLHTP

SEQ ID NO: 1406228 - protein, 9 aa, Homo Sapiens
VKLTKQSGH

SEQ ID NO: 1406229 - protein, 9 aa, Homo Sapiens
SVDSLVEAV

SEQ ID NO: 1406230 - protein, 9 aa, Homo Sapiens
QIFTKSPQT

SEQ ID NO: 1406231 - protein, 9 aa, Homo Sapiens
AKGYTVLAV

SEQ ID NO: 1406232 - protein, 9 aa, Homo Sapiens
PNKSAVIPD

SEQ ID NO: 1406233 - protein, 9 aa, Homo Sapiens
YLIILPGNS

SEQ ID NO: 1406234 - protein, 9 aa, Homo Sapiens
DIKWIKKDP

SEQ ID NO: 1406235 - protein, 9 aa, Homo Sapiens
LFLTGTWAD

SEQ ID NO: 1406236 - protein, 9 aa, Homo Sapiens
EIPGRIICI

SEQ ID NO: 1406237 - protein, 9 aa, Homo Sapiens
LLPVLMVDE

SEQ ID NO: 1406238 - protein, 9 aa, Homo Sapiens
LTTLLIGLA

SEQ ID NO: 1406239 - protein, 9 aa, Homo Sapiens
NHRIKFEEK

SEQ ID NO: 1406240 - protein, 9 aa, Homo Sapiens
DTEIIDTKL

SEQ ID NO: 1406241 - protein, 9 aa, Homo Sapiens
SNPTKTKKA

SEQ ID NO: 1406242 - protein, 9 aa, Homo Sapiens
RIKNPEHHP

SEQ ID NO: 1406243 - protein, 9 aa, Homo Sapiens
CIEPVHNLL

SEQ ID NO: 1406244 - protein, 9 aa, Homo Sapiens
AAPLAPPAL

SEQ ID NO: 1406245 - protein, 9 aa, Homo Sapiens
IGGGTPLSI

SEQ ID NO: 1406246 - protein, 9 aa, Homo Sapiens
ARLRIAKGA

SEQ ID NO: 1406247 - protein, 9 aa, Homo Sapiens
CSHFPTPLL

SEQ ID NO: 1406248 - protein, 9 aa, Homo Sapiens
KNMRPVDMS

SEQ ID NO: 1406249 - protein, 9 aa, Homo Sapiens
KNAHNVDHT

SEQ ID NO: 1406250 - protein, 9 aa, Homo Sapiens
ELVYETDIK

SEQ ID NO: 1406251 - protein, 9 aa, Homo Sapiens
VLAVAATHC

SEQ ID NO: 1406252 - protein, 9 aa, Homo Sapiens
YSFKPFFLF

SEQ ID NO: 1406253 - protein, 9 aa, Homo Sapiens
SALPRPSLT

SEQ ID NO: 1406254 - protein, 9 aa, Homo Sapiens
CSVTYSALW

SEQ ID NO: 1406255 - protein, 9 aa, Homo Sapiens
DGDEEEEDD

SEQ ID NO: 1406256 - protein, 9 aa, Homo Sapiens
CGWIFKHKT

SEQ ID NO: 1406257 - protein, 9 aa, Homo Sapiens
VCALEELCK

SEQ ID NO: 1406258 - protein, 9 aa, Homo Sapiens
RSREAGPVQ

SEQ ID NO: 1406259 - protein, 9 aa, Homo Sapiens
KTKKARFST

SEQ ID NO: 1406260 - protein, 9 aa, Homo Sapiens
HYSMDVLAS

SEQ ID NO: 1406261 - protein, 9 aa, Homo Sapiens
SPAGIICVA

SEQ ID NO: 1406262 - protein, 9 aa, Homo Sapiens
QHMTFPPEA

SEQ ID NO: 1406263 - protein, 9 aa, Homo Sapiens
LHPRYLPVH

SEQ ID NO: 1406264 - protein, 9 aa, Homo Sapiens
KPYICAKCG

SEQ ID NO: 1406265 - protein, 9 aa, Homo Sapiens
FSRVLRRMV

SEQ ID NO: 1406266 - protein, 9 aa, Homo Sapiens
TPFLNSQVG

SEQ ID NO: 1406267 - protein, 9 aa, Homo Sapiens
LRLLRVLQN

SEQ ID NO: 1406268 - protein, 9 aa, Homo Sapiens
FGIVVHEFG

SEQ ID NO: 1406269 - protein, 9 aa, Homo Sapiens
HIGSSSRGD

SEQ ID NO: 1406270 - protein, 9 aa, Homo Sapiens
ICFTISLAP

SEQ ID NO: 1406271 - protein, 9 aa, Homo Sapiens
STLSQPPPQ

SEQ ID NO: 1406272 - protein, 9 aa, Homo Sapiens
INTEECITL

SEQ ID NO: 1406273 - protein, 9 aa, Homo Sapiens
ALLADLGFL

SEQ ID NO: 1406274 - protein, 9 aa, Homo Sapiens
QTRVKLTKQ

SEQ ID NO: 1406275 - protein, 9 aa, Homo Sapiens
AKGASMTIS

SEQ ID NO: 1406276 - protein, 9 aa, Homo Sapiens
PKRKYKPKP

SEQ ID NO: 1406277 - protein, 9 aa, Homo Sapiens
VAWGPSWRM

SEQ ID NO: 1406278 - protein, 9 aa, Homo Sapiens
TGIRKVCLL

SEQ ID NO: 1406279 - protein, 9 aa, Homo Sapiens
GFHMKQGVL

SEQ ID NO: 1406280 - protein, 9 aa, Homo Sapiens
PTSSSFSKW

SEQ ID NO: 1406281 - protein, 9 aa, Homo Sapiens
TSYRCSRMR

SEQ ID NO: 1406282 - protein, 9 aa, Homo Sapiens
ITPMMNPLI

SEQ ID NO: 1406283 - protein, 9 aa, Homo Sapiens
ESSKKYAKA

SEQ ID NO: 1406284 - protein, 9 aa, Homo Sapiens
EVNDINDNP

SEQ ID NO: 1406285 - protein, 9 aa, Homo Sapiens
QSTGPGWEE

SEQ ID NO: 1406286 - protein, 9 aa, Homo Sapiens
GHLWRAPPG

SEQ ID NO: 1406287 - protein, 9 aa, Homo Sapiens
CSVAWGPSW

SEQ ID NO: 1406288 - protein, 9 aa, Homo Sapiens
KSEMAHIQQ

SEQ ID NO: 1406289 - protein, 9 aa, Homo Sapiens
QECPRKNAF

SEQ ID NO: 1406290 - protein, 9 aa, Homo Sapiens
APATKMATI

SEQ ID NO: 1406291 - protein, 9 aa, Homo Sapiens
DKSSKRDTE

SEQ ID NO: 1406292 - protein, 9 aa, Homo Sapiens
FAQKNILLV

SEQ ID NO: 1406293 - protein, 9 aa, Homo Sapiens
LYCDPDWSS

SEQ ID NO: 1406294 - protein, 9 aa, Homo Sapiens
CFMAVTSSC

SEQ ID NO: 1406295 - protein, 9 aa, Homo Sapiens
SVNVTASTH

SEQ ID NO: 1406296 - protein, 9 aa, Homo Sapiens
KNPLAMYPN

SEQ ID NO: 1406297 - protein, 9 aa, Homo Sapiens
FEDDTPRRG

SEQ ID NO: 1406298 - protein, 9 aa, Homo Sapiens
PFFLFGEIP

SEQ ID NO: 1406299 - protein, 9 aa, Homo Sapiens
GTACGMAHR

SEQ ID NO: 1406300 - protein, 9 aa, Homo Sapiens
NYNLPMHKT

SEQ ID NO: 1406301 - protein, 9 aa, Homo Sapiens
NFSLKLCIY

SEQ ID NO: 1406302 - protein, 9 aa, Homo Sapiens
TITGQHMTF

SEQ ID NO: 1406303 - protein, 9 aa, Homo Sapiens
FKPFFLFGE

SEQ ID NO: 1406304 - protein, 9 aa, Homo Sapiens
TCLLASWQP

SEQ ID NO: 1406305 - protein, 9 aa, Homo Sapiens
WVNYDFGPI

SEQ ID NO: 1406306 - protein, 9 aa, Homo Sapiens
GPCASLLST

SEQ ID NO: 1406307 - protein, 9 aa, Homo Sapiens
ASSSECIEP

SEQ ID NO: 1406308 - protein, 9 aa, Homo Sapiens
EPLNEVNNF

SEQ ID NO: 1406309 - protein, 9 aa, Homo Sapiens
HSLQAKSTY

SEQ ID NO: 1406310 - protein, 9 aa, Homo Sapiens
HREDLVVPA

SEQ ID NO: 1406311 - protein, 9 aa, Homo Sapiens
QRWFCRMWF

SEQ ID NO: 1406312 - protein, 9 aa, Homo Sapiens
KTYDNPDFN

SEQ ID NO: 1406313 - protein, 9 aa, Homo Sapiens
ASTDPELRR

SEQ ID NO: 1406314 - protein, 9 aa, Homo Sapiens
KKRRKVYGI

SEQ ID NO: 1406315 - protein, 9 aa, Homo Sapiens
GFICTNRKA

SEQ ID NO: 1406316 - protein, 9 aa, Homo Sapiens
VHKATAEKF

SEQ ID NO: 1406317 - protein, 9 aa, Homo Sapiens
DGKKEDEEN

SEQ ID NO: 1406318 - protein, 9 aa, Homo Sapiens
SAAQKMKKA

SEQ ID NO: 1406319 - protein, 9 aa, Homo Sapiens
PDRQEHQKP

SEQ ID NO: 1406320 - protein, 9 aa, Homo Sapiens
TSVLACISP

SEQ ID NO: 1406321 - protein, 9 aa, Homo Sapiens
GQQSLPGPG

SEQ ID NO: 1406322 - protein, 9 aa, Homo Sapiens
SKQNCSHFP

SEQ ID NO: 1406323 - protein, 9 aa, Homo Sapiens
GIISVEILQ

SEQ ID NO: 1406324 - protein, 9 aa, Homo Sapiens
QPPPQAPSQ

SEQ ID NO: 1406325 - protein, 9 aa, Homo Sapiens
CRIQKSDFS

SEQ ID NO: 1406326 - protein, 9 aa, Homo Sapiens
SVTLNVTAA

SEQ ID NO: 1406327 - protein, 9 aa, Homo Sapiens
GAFSHVTLH

SEQ ID NO: 1406328 - protein, 9 aa, Homo Sapiens
KLYTCNQYG

SEQ ID NO: 1406329 - protein, 9 aa, Homo Sapiens
GPGWEEPGG

SEQ ID NO: 1406330 - protein, 9 aa, Homo Sapiens
TRKRPYLCW

SEQ ID NO: 1406331 - protein, 9 aa, Homo Sapiens
ECGWIFKHK

SEQ ID NO: 1406332 - protein, 9 aa, Homo Sapiens
PKGSGTEDN

SEQ ID NO: 1406333 - protein, 9 aa, Homo Sapiens
GVADLGRLE

SEQ ID NO: 1406334 - protein, 9 aa, Homo Sapiens
WIFKHKTDH

SEQ ID NO: 1406335 - protein, 9 aa, Homo Sapiens
ERIHTSNKP

SEQ ID NO: 1406336 - protein, 9 aa, Homo Sapiens
PGTACGMAH

SEQ ID NO: 1406337 - protein, 9 aa, Homo Sapiens
GLMQLMWLY

SEQ ID NO: 1406338 - protein, 9 aa, Homo Sapiens
HHCECYESY

SEQ ID NO: 1406339 - protein, 9 aa, Homo Sapiens
GTIVEAHLK

SEQ ID NO: 1406340 - protein, 9 aa, Homo Sapiens
EPNEVNPFE

SEQ ID NO: 1406341 - protein, 9 aa, Homo Sapiens
NHCASSEHT

SEQ ID NO: 1406342 - protein, 9 aa, Homo Sapiens
AFSHVTLHA

SEQ ID NO: 1406343 - protein, 9 aa, Homo Sapiens
KQEFSECLI

SEQ ID NO: 1406344 - protein, 9 aa, Homo Sapiens
MPPSALNPP

SEQ ID NO: 1406345 - protein, 9 aa, Homo Sapiens
LYIHFKKHL

SEQ ID NO: 1406346 - protein, 9 aa, Homo Sapiens
ILPGNSLII

SEQ ID NO: 1406347 - protein, 9 aa, Homo Sapiens
EVLELAGNT

SEQ ID NO: 1406348 - protein, 9 aa, Homo Sapiens
VCSCIEGVD

SEQ ID NO: 1406349 - protein, 9 aa, Homo Sapiens
IWNLNPVFG

SEQ ID NO: 1406350 - protein, 9 aa, Homo Sapiens
LNVLALNFE

SEQ ID NO: 1406351 - protein, 9 aa, Homo Sapiens
HMTFPPEAL

SEQ ID NO: 1406352 - protein, 9 aa, Homo Sapiens
LHSCRIQKS

SEQ ID NO: 1406353 - protein, 9 aa, Homo Sapiens
GLYPLTAIS

SEQ ID NO: 1406354 - protein, 9 aa, Homo Sapiens
GPHLLQPAS

SEQ ID NO: 1406355 - protein, 9 aa, Homo Sapiens
WFCRMWFMN

SEQ ID NO: 1406356 - protein, 9 aa, Homo Sapiens
GMYLLITGP

SEQ ID NO: 1406357 - protein, 9 aa, Homo Sapiens
VPKKNSRKL

SEQ ID NO: 1406358 - protein, 9 aa, Homo Sapiens
ICAKRKLYQ

SEQ ID NO: 1406359 - protein, 9 aa, Homo Sapiens
KQEEKMETE

SEQ ID NO: 1406360 - protein, 9 aa, Homo Sapiens
LQRQQWEAR

SEQ ID NO: 1406361 - protein, 9 aa, Homo Sapiens
VVLQVGDLQ

SEQ ID NO: 1406362 - protein, 9 aa, Homo Sapiens
LDNYLFFLM

SEQ ID NO: 1406363 - protein, 9 aa, Homo Sapiens
IVKCPHIQK

SEQ ID NO: 1406364 - protein, 9 aa, Homo Sapiens
NPTKTKKAR

SEQ ID NO: 1406365 - protein, 9 aa, Homo Sapiens
PNLHPPMPP

SEQ ID NO: 1406366 - protein, 9 aa, Homo Sapiens
WCRPWLEQM

SEQ ID NO: 1406367 - protein, 9 aa, Homo Sapiens
QSAPHILTG

SEQ ID NO: 1406368 - protein, 9 aa, Homo Sapiens
MVARMLLED

SEQ ID NO: 1406369 - protein, 9 aa, Homo Sapiens
ETKWECKAY

SEQ ID NO: 1406370 - protein, 9 aa, Homo Sapiens
ASWAPQMRA

SEQ ID NO: 1406371 - protein, 9 aa, Homo Sapiens
HHDPPPMDQ

SEQ ID NO: 1406372 - protein, 9 aa, Homo Sapiens
ARCPGHASR

SEQ ID NO: 1406373 - protein, 9 aa, Homo Sapiens
QNLDPTSSS

SEQ ID NO: 1406374 - protein, 9 aa, Homo Sapiens
RPTSRARQS

SEQ ID NO: 1406375 - protein, 9 aa, Homo Sapiens
APRGLLCPA

SEQ ID NO: 1406376 - protein, 9 aa, Homo Sapiens
CTNRKALSF

SEQ ID NO: 1406377 - protein, 9 aa, Homo Sapiens
CPHIQKETG

SEQ ID NO: 1406378 - protein, 9 aa, Homo Sapiens
HYRAPELIF

SEQ ID NO: 1406379 - protein, 9 aa, Homo Sapiens
RVKLTKQSG

SEQ ID NO: 1406380 - protein, 9 aa, Homo Sapiens
EWKSALANL

SEQ ID NO: 1406381 - protein, 9 aa, Homo Sapiens
HCECYESYT

SEQ ID NO: 1406382 - protein, 9 aa, Homo Sapiens
TISLAPQTL

SEQ ID NO: 1406383 - protein, 9 aa, Homo Sapiens
ALVIFSVVN

SEQ ID NO: 1406384 - protein, 9 aa, Homo Sapiens
TIAVALLAD

SEQ ID NO: 1406385 - protein, 9 aa, Homo Sapiens
FLFGEIPGR

SEQ ID NO: 1406386 - protein, 9 aa, Homo Sapiens
ALVAPRGLL

SEQ ID NO: 1406387 - protein, 9 aa, Homo Sapiens
LSFCQHKLP

SEQ ID NO: 1406388 - protein, 9 aa, Homo Sapiens
AVRHEPTLL

SEQ ID NO: 1406389 - protein, 9 aa, Homo Sapiens
LRHICGAVH

SEQ ID NO: 1406390 - protein, 9 aa, Homo Sapiens
PIYEPKDCY

SEQ ID NO: 1406391 - protein, 9 aa, Homo Sapiens
SLPPTVTST

SEQ ID NO: 1406392 - protein, 9 aa, Homo Sapiens
KGYTVLAVA

SEQ ID NO: 1406393 - protein, 9 aa, Homo Sapiens
SFKPFFLFG

SEQ ID NO: 1406394 - protein, 9 aa, Homo Sapiens
RHHERCSDS

SEQ ID NO: 1406395 - protein, 9 aa, Homo Sapiens
RTEDLKTEI

SEQ ID NO: 1406396 - protein, 9 aa, Homo Sapiens
KKAHFLKTW

SEQ ID NO: 1406397 - protein, 9 aa, Homo Sapiens
KNAFHHTVR

SEQ ID NO: 1406398 - protein, 9 aa, Homo Sapiens
LEEPSITSG

SEQ ID NO: 1406399 - protein, 9 aa, Homo Sapiens
VRRCRHHER

SEQ ID NO: 1406400 - protein, 9 aa, Homo Sapiens
FKGIAQRTF

SEQ ID NO: 1406401 - protein, 9 aa, Homo Sapiens
MGRTLIVEV

SEQ ID NO: 1406402 - protein, 9 aa, Homo Sapiens
REAGPVQSC

SEQ ID NO: 1406403 - protein, 9 aa, Homo Sapiens
STYLHKLRE

SEQ ID NO: 1406404 - protein, 9 aa, Homo Sapiens
TMTFEEREN

SEQ ID NO: 1406405 - protein, 9 aa, Homo Sapiens
HQKSPLFQF

SEQ ID NO: 1406406 - protein, 9 aa, Homo Sapiens
NVNYFILES

SEQ ID NO: 1406407 - protein, 9 aa, Homo Sapiens
PWLEQMLHS

SEQ ID NO: 1406408 - protein, 9 aa, Homo Sapiens
GSLLQDIVV

SEQ ID NO: 1406409 - protein, 9 aa, Homo Sapiens
CLQSRVTNQ

SEQ ID NO: 1406410 - protein, 9 aa, Homo Sapiens
GVISARCNL

SEQ ID NO: 1406411 - protein, 9 aa, Homo Sapiens
CDPGYEFQG

SEQ ID NO: 1406412 - protein, 9 aa, Homo Sapiens
SGVISARCN

SEQ ID NO: 1406413 - protein, 9 aa, Homo Sapiens
PCFWGSDNR

SEQ ID NO: 1406414 - protein, 9 aa, Homo Sapiens
ICSRHYRAP

SEQ ID NO: 1406415 - protein, 9 aa, Homo Sapiens
DDEDDGDEE

SEQ ID NO: 1406416 - protein, 9 aa, Homo Sapiens
NRHTIEVNR

SEQ ID NO: 1406417 - protein, 9 aa, Homo Sapiens
LMLSWHQAT

SEQ ID NO: 1406418 - protein, 9 aa, Homo Sapiens
GVLPDRQEH

SEQ ID NO: 1406419 - protein, 9 aa, Homo Sapiens
WTMTFEERE

SEQ ID NO: 1406420 - protein, 9 aa, Homo Sapiens
EASSSECIE

SEQ ID NO: 1406421 - protein, 9 aa, Homo Sapiens
PGVTMHRED

SEQ ID NO: 1406422 - protein, 9 aa, Homo Sapiens
TSGARFCRA

SEQ ID NO: 1406423 - protein, 9 aa, Homo Sapiens
SGARFCRAG

SEQ ID NO: 1406424 - protein, 9 aa, Homo Sapiens
NLHPPMPPS

SEQ ID NO: 1406425 - protein, 9 aa, Homo Sapiens
SSETLLEVN

SEQ ID NO: 1406426 - protein, 9 aa, Homo Sapiens
PCSRQRQIL

SEQ ID NO: 1406427 - protein, 9 aa, Homo Sapiens
NFLFGRSLG

SEQ ID NO: 1406428 - protein, 9 aa, Homo Sapiens
RPSLTINGS

SEQ ID NO: 1406429 - protein, 9 aa, Homo Sapiens
ERRIKNPEH

SEQ ID NO: 1406430 - protein, 9 aa, Homo Sapiens
ESGGPHLLQ

SEQ ID NO: 1406431 - protein, 9 aa, Homo Sapiens
LEVSYIKVV

SEQ ID NO: 1406432 - protein, 9 aa, Homo Sapiens
KISFFVMFL

SEQ ID NO: 1406433 - protein, 9 aa, Homo Sapiens
YDSLGAFSH

SEQ ID NO: 1406434 - protein, 9 aa, Homo Sapiens
YQQGQKQLY

SEQ ID NO: 1406435 - protein, 9 aa, Homo Sapiens
PLAPPALVA

SEQ ID NO: 1406436 - protein, 9 aa, Homo Sapiens
QQECPRKNA

SEQ ID NO: 1406437 - protein, 9 aa, Homo Sapiens
AHNVDHTSV

SEQ ID NO: 1406438 - protein, 9 aa, Homo Sapiens
REDLVVPAG

SEQ ID NO: 1406439 - protein, 9 aa, Homo Sapiens
LLVTPPRPC

SEQ ID NO: 1406440 - protein, 9 aa, Homo Sapiens
LDVTQLTTM

SEQ ID NO: 1406441 - protein, 9 aa, Homo Sapiens
QEEKIKELR

SEQ ID NO: 1406442 - protein, 9 aa, Homo Sapiens
IAKGASMTI

SEQ ID NO: 1406443 - protein, 9 aa, Homo Sapiens
KGVGGGAGV

SEQ ID NO: 1406444 - protein, 9 aa, Homo Sapiens
DFSNNWNSS

SEQ ID NO: 1406445 - protein, 9 aa, Homo Sapiens
RPEPPKIRM

SEQ ID NO: 1406446 - protein, 9 aa, Homo Sapiens
PVEGTSPPS

SEQ ID NO: 1406447 - protein, 9 aa, Homo Sapiens
FQKNRILKQ

SEQ ID NO: 1406448 - protein, 9 aa, Homo Sapiens
SSCSLQCSV

SEQ ID NO: 1406449 - protein, 9 aa, Homo Sapiens
LDYFHHWPV

SEQ ID NO: 1406450 - protein, 9 aa, Homo Sapiens
AVHGQQSLP

SEQ ID NO: 1406451 - protein, 9 aa, Homo Sapiens
ISVEILQST

SEQ ID NO: 1406452 - protein, 9 aa, Homo Sapiens
PAQKTARCP

SEQ ID NO: 1406453 - protein, 9 aa, Homo Sapiens
MKKAHFLKT

SEQ ID NO: 1406454 - protein, 9 aa, Homo Sapiens
NFYSDLNSE

SEQ ID NO: 1406455 - protein, 9 aa, Homo Sapiens
DLDKTKNFL

SEQ ID NO: 1406456 - protein, 9 aa, Homo Sapiens
VDHTSVLAC

SEQ ID NO: 1406457 - protein, 9 aa, Homo Sapiens
SVAPEFRCL

SEQ ID NO: 1406458 - protein, 9 aa, Homo Sapiens
TIFANWRGF

SEQ ID NO: 1406459 - protein, 9 aa, Homo Sapiens
QKTARCPGH

SEQ ID NO: 1406460 - protein, 9 aa, Homo Sapiens
QAKSTYLHK

SEQ ID NO: 1406461 - protein, 9 aa, Homo Sapiens
MKRLCTVWD

SEQ ID NO: 1406462 - protein, 9 aa, Homo Sapiens
SLLDFMLRY

SEQ ID NO: 1406463 - protein, 9 aa, Homo Sapiens
VGMAGAAID

SEQ ID NO: 1406464 - protein, 9 aa, Homo Sapiens
PRPSLTING

SEQ ID NO: 1406465 - protein, 9 aa, Homo Sapiens
ITVFGKRIL

SEQ ID NO: 1406466 - protein, 9 aa, Homo Sapiens
VYETDIKWI

SEQ ID NO: 1406467 - protein, 9 aa, Homo Sapiens
AYEDTKTLE

SEQ ID NO: 1406468 - protein, 9 aa, Homo Sapiens
NPDALGDVA

SEQ ID NO: 1406469 - protein, 9 aa, Homo Sapiens
GHASRENPH

SEQ ID NO: 1406470 - protein, 9 aa, Homo Sapiens
DPTSSSFSK

SEQ ID NO: 1406471 - protein, 9 aa, Homo Sapiens
EIVQVGKEM

SEQ ID NO: 1406472 - protein, 9 aa, Homo Sapiens
LMWLYLDHN

SEQ ID NO: 1406473 - protein, 9 aa, Homo Sapiens
QSTKRKNMR

SEQ ID NO: 1406474 - protein, 9 aa, Homo Sapiens
PGMIFSRVL

SEQ ID NO: 1406475 - protein, 9 aa, Homo Sapiens
RYIFTNTFI

SEQ ID NO: 1406476 - protein, 9 aa, Homo Sapiens
LVSASRDRT

SEQ ID NO: 1406477 - protein, 9 aa, Homo Sapiens
GPHPPGHHD

SEQ ID NO: 1406478 - protein, 9 aa, Homo Sapiens
GLQRWFCRM

SEQ ID NO: 1406479 - protein, 9 aa, Homo Sapiens
KYKPKPREP

SEQ ID NO: 1406480 - protein, 9 aa, Homo Sapiens
DLRHICGAV

SEQ ID NO: 1406481 - protein, 9 aa, Homo Sapiens
TTFNGLTPQ

SEQ ID NO: 1406482 - protein, 9 aa, Homo Sapiens
FSPHGNLLV

SEQ ID NO: 1406483 - protein, 9 aa, Homo Sapiens
LNETELTAA

SEQ ID NO: 1406484 - protein, 9 aa, Homo Sapiens
TVGHHHRPR

SEQ ID NO: 1406485 - protein, 9 aa, Homo Sapiens
SEPTPRGMP

SEQ ID NO: 1406486 - protein, 9 aa, Homo Sapiens
HGQQSLPGP

SEQ ID NO: 1406487 - protein, 9 aa, Homo Sapiens
GQECYRGNG

SEQ ID NO: 1406488 - protein, 9 aa, Homo Sapiens
PFENKNVEV

SEQ ID NO: 1406489 - protein, 9 aa, Homo Sapiens
NRKALSFNH

SEQ ID NO: 1406490 - protein, 9 aa, Homo Sapiens
KELRKIHQL

SEQ ID NO: 1406491 - protein, 9 aa, Homo Sapiens
PPSALNPPA

SEQ ID NO: 1406492 - protein, 9 aa, Homo Sapiens
GAAVHSPWP

SEQ ID NO: 1406493 - protein, 9 aa, Homo Sapiens
DSARRKRIP

SEQ ID NO: 1406494 - protein, 9 aa, Homo Sapiens
KRGSVDSLV

SEQ ID NO: 1406495 - protein, 9 aa, Homo Sapiens
GGSEAGSKG

SEQ ID NO: 1406496 - protein, 9 aa, Homo Sapiens
VQVAEALTL

SEQ ID NO: 1406497 - protein, 9 aa, Homo Sapiens
GKSSLLDFM

SEQ ID NO: 1406498 - protein, 9 aa, Homo Sapiens
ALGDVAGVP

SEQ ID NO: 1406499 - protein, 9 aa, Homo Sapiens
DVTQLTTMC

SEQ ID NO: 1406500 - protein, 9 aa, Homo Sapiens
RKQGGAAKN

SEQ ID NO: 1406501 - protein, 9 aa, Homo Sapiens
QGGAAKNTR

SEQ ID NO: 1406502 - protein, 9 aa, Homo Sapiens
DTGARDPEW

SEQ ID NO: 1406503 - protein, 9 aa, Homo Sapiens
SKGSGEGEG

SEQ ID NO: 1406504 - protein, 9 aa, Homo Sapiens
SPWPHKMAS

SEQ ID NO: 1406505 - protein, 9 aa, Homo Sapiens
FSQLVEHCQ

SEQ ID NO: 1406506 - protein, 9 aa, Homo Sapiens
ACGMAHRDS

SEQ ID NO: 1406507 - protein, 9 aa, Homo Sapiens
DAPATKMAT

SEQ ID NO: 1406508 - protein, 9 aa, Homo Sapiens
LDVDSSPKG

SEQ ID NO: 1406509 - protein, 9 aa, Homo Sapiens
KNFLFGRSL

SEQ ID NO: 1406510 - protein, 9 aa, Homo Sapiens
KERPLGRKP

SEQ ID NO: 1406511 - protein, 9 aa, Homo Sapiens
EIRLSSCCL

SEQ ID NO: 1406512 - protein, 9 aa, Homo Sapiens
TSSCSLQCS

SEQ ID NO: 1406513 - protein, 9 aa, Homo Sapiens
ARGEAKKRR

SEQ ID NO: 1406514 - protein, 9 aa, Homo Sapiens
PWPHKMASY

SEQ ID NO: 1406515 - protein, 9 aa, Homo Sapiens
ISMFYGVIT

SEQ ID NO: 1406516 - protein, 9 aa, Homo Sapiens
PTSSCWGLV

SEQ ID NO: 1406517 - protein, 9 aa, Homo Sapiens
ERYYDITVL

SEQ ID NO: 1406518 - protein, 9 aa, Homo Sapiens
EHHPGVTMH

SEQ ID NO: 1406519 - protein, 9 aa, Homo Sapiens
HTSVLACIS

SEQ ID NO: 1406520 - protein, 9 aa, Homo Sapiens
ATLRCPAVP

SEQ ID NO: 1406521 - protein, 9 aa, Homo Sapiens
GGHLWRAPP

SEQ ID NO: 1406522 - protein, 9 aa, Homo Sapiens
IVGNILLII

SEQ ID NO: 1406523 - protein, 9 aa, Homo Sapiens
SRLSASQIW

SEQ ID NO: 1406524 - protein, 9 aa, Homo Sapiens
GVTVIASTD

SEQ ID NO: 1406525 - protein, 9 aa, Homo Sapiens
FGYNTGLYP

SEQ ID NO: 1406526 - protein, 9 aa, Homo Sapiens
AVHSPWPHK

SEQ ID NO: 1406527 - protein, 9 aa, Homo Sapiens
QDIVVSGYV

SEQ ID NO: 1406528 - protein, 9 aa, Homo Sapiens
EAHVSTNLK

SEQ ID NO: 1406529 - protein, 9 aa, Homo Sapiens
SCSLQCSVA

SEQ ID NO: 1406530 - protein, 9 aa, Homo Sapiens
QGQKQLYNE

SEQ ID NO: 1406531 - protein, 9 aa, Homo Sapiens
SPRPPPLVR

SEQ ID NO: 1406532 - protein, 9 aa, Homo Sapiens
INDGSPVLK

SEQ ID NO: 1406533 - protein, 9 aa, Homo Sapiens
LFHDTSIGN

SEQ ID NO: 1406534 - protein, 9 aa, Homo Sapiens
WEARKKPAA

SEQ ID NO: 1406535 - protein, 9 aa, Homo Sapiens
LPSAAQKMK

SEQ ID NO: 1406536 - protein, 9 aa, Homo Sapiens
PHVSPAGII

SEQ ID NO: 1406537 - protein, 9 aa, Homo Sapiens
STASLAKEL

SEQ ID NO: 1406538 - protein, 9 aa, Homo Sapiens
LQVGDLQAV

SEQ ID NO: 1406539 - protein, 9 aa, Homo Sapiens
DGSLLQDIV

SEQ ID NO: 1406540 - protein, 9 aa, Homo Sapiens
HHRPRPIRP

SEQ ID NO: 1406541 - protein, 9 aa, Homo Sapiens
KSSKRDTEG

SEQ ID NO: 1406542 - protein, 9 aa, Homo Sapiens
PPPCCDPSG

SEQ ID NO: 1406543 - protein, 9 aa, Homo Sapiens
TLYCDPDWS

SEQ ID NO: 1406544 - protein, 9 aa, Homo Sapiens
DIRLNGSAA

SEQ ID NO: 1406545 - protein, 9 aa, Homo Sapiens
VNPFENKNV

SEQ ID NO: 1406546 - protein, 9 aa, Homo Sapiens
MAAPKNRHT

SEQ ID NO: 1406547 - protein, 9 aa, Homo Sapiens
CSSPSPSPT

SEQ ID NO: 1406548 - protein, 9 aa, Homo Sapiens
TKTKKARFS

SEQ ID NO: 1406549 - protein, 9 aa, Homo Sapiens
AWGPSWRMR

SEQ ID NO: 1406550 - protein, 9 aa, Homo Sapiens
VNVTASTHR

SEQ ID NO: 1406551 - protein, 9 aa, Homo Sapiens
HLWRAPPGR

SEQ ID NO: 1406552 - protein, 9 aa, Homo Sapiens
HQTPQPHLC

SEQ ID NO: 1406553 - protein, 9 aa, Homo Sapiens
RIHTSNKPY

SEQ ID NO: 1406554 - protein, 9 aa, Homo Sapiens
LSASQIWNL

SEQ ID NO: 1406555 - protein, 9 aa, Homo Sapiens
REDAMKEFC

SEQ ID NO: 1406556 - protein, 9 aa, Homo Sapiens
DIRGRACFC

SEQ ID NO: 1406557 - protein, 9 aa, Homo Sapiens
AGAAIDTVE

SEQ ID NO: 1406558 - protein, 9 aa, Homo Sapiens
PLSISRPTS

SEQ ID NO: 1406559 - protein, 9 aa, Homo Sapiens
THIFRHQKL

SEQ ID NO: 1406560 - protein, 9 aa, Homo Sapiens
RWKKLFSQL

SEQ ID NO: 1406561 - protein, 9 aa, Homo Sapiens
VRNGNRQWS

SEQ ID NO: 1406562 - protein, 9 aa, Homo Sapiens
KQQEELRTV

SEQ ID NO: 1406563 - protein, 9 aa, Homo Sapiens
WSARSESAQ

SEQ ID NO: 1406564 - protein, 9 aa, Homo Sapiens
EVSYIKVVH

SEQ ID NO: 1406565 - protein, 9 aa, Homo Sapiens
FDLEWQNQM

SEQ ID NO: 1406566 - protein, 9 aa, Homo Sapiens
SSSECIEPV

SEQ ID NO: 1406567 - protein, 9 aa, Homo Sapiens
VISARCNLC

SEQ ID NO: 1406568 - protein, 9 aa, Homo Sapiens
TKQSGHTQT

SEQ ID NO: 1406569 - protein, 9 aa, Homo Sapiens
RLRIAKGAS

SEQ ID NO: 1406570 - protein, 9 aa, Homo Sapiens
TKVPALRLP

SEQ ID NO: 1406571 - protein, 9 aa, Homo Sapiens
RGMPYHQSA

SEQ ID NO: 1406572 - protein, 9 aa, Homo Sapiens
DFLDSVNRR

SEQ ID NO: 1406573 - protein, 9 aa, Homo Sapiens
SRHYRAPEL

SEQ ID NO: 1406574 - protein, 9 aa, Homo Sapiens
GEQVCALEE

SEQ ID NO: 1406575 - protein, 9 aa, Homo Sapiens
DLGLRMVEI

SEQ ID NO: 1406576 - protein, 9 aa, Homo Sapiens
ASLKKNNIP

SEQ ID NO: 1406577 - protein, 9 aa, Homo Sapiens
LFGEIPGRI

SEQ ID NO: 1406578 - protein, 9 aa, Homo Sapiens
RLAGGSANT

SEQ ID NO: 1406579 - protein, 9 aa, Homo Sapiens
PLILWPQAA

SEQ ID NO: 1406580 - protein, 9 aa, Homo Sapiens
EMHFRWENN

SEQ ID NO: 1406581 - protein, 9 aa, Homo Sapiens
FLNVLALNF

SEQ ID NO: 1406582 - protein, 9 aa, Homo Sapiens
KEDEENKYL

SEQ ID NO: 1406583 - protein, 9 aa, Homo Sapiens
DINLKERFV

SEQ ID NO: 1406584 - protein, 9 aa, Homo Sapiens
PLNEVNNFP

SEQ ID NO: 1406585 - protein, 9 aa, Homo Sapiens
QSLPGPGRH

SEQ ID NO: 1406586 - protein, 9 aa, Homo Sapiens
GNDKQGFHM

SEQ ID NO: 1406587 - protein, 9 aa, Homo Sapiens
RCPAVPAAA

SEQ ID NO: 1406588 - protein, 9 aa, Homo Sapiens
GHNSSGETL

SEQ ID NO: 1406589 - protein, 9 aa, Homo Sapiens
CASSEHTQM

SEQ ID NO: 1406590 - protein, 9 aa, Homo Sapiens
VTVIILSYS

SEQ ID NO: 1406591 - protein, 9 aa, Homo Sapiens
YLLSVMVYD

SEQ ID NO: 1406592 - protein, 9 aa, Homo Sapiens
HGQECYRGN

SEQ ID NO: 1406593 - protein, 9 aa, Homo Sapiens
ELSKGGEQV

SEQ ID NO: 1406594 - protein, 9 aa, Homo Sapiens
SQECLQSRV

SEQ ID NO: 1406595 - protein, 9 aa, Homo Sapiens
PIRPPFLES

SEQ ID NO: 1406596 - protein, 9 aa, Homo Sapiens
WKDKDPTEW

SEQ ID NO: 1406597 - protein, 9 aa, Homo Sapiens
KEWKSALAN

SEQ ID NO: 1406598 - protein, 9 aa, Homo Sapiens
VIFSVVNAG

SEQ ID NO: 1406599 - protein, 9 aa, Homo Sapiens
HHHRPRPIR

SEQ ID NO: 1406600 - protein, 9 aa, Homo Sapiens
GICQRDVIL

SEQ ID NO: 1406601 - protein, 9 aa, Homo Sapiens
NGQQSQEVP

SEQ ID NO: 1406602 - protein, 9 aa, Homo Sapiens
IKFEEKNIA

SEQ ID NO: 1406603 - protein, 9 aa, Homo Sapiens
YESYTLNAD

SEQ ID NO: 1406604 - protein, 9 aa, Homo Sapiens
HTLQEHNLD

SEQ ID NO: 1406605 - protein, 9 aa, Homo Sapiens
EDRRETGLF

SEQ ID NO: 1406606 - protein, 9 aa, Homo Sapiens
PGRWCFPTQ

SEQ ID NO: 1406607 - protein, 9 aa, Homo Sapiens
HIKRPKNAF

SEQ ID NO: 1406608 - protein, 9 aa, Homo Sapiens
YECSECGWI

SEQ ID NO: 1406609 - protein, 9 aa, Homo Sapiens
SLGSLPQQM

SEQ ID NO: 1406610 - protein, 9 aa, Homo Sapiens
GRCISQTEG

SEQ ID NO: 1406611 - protein, 9 aa, Homo Sapiens
GRWCFPTQA

SEQ ID NO: 1406612 - protein, 9 aa, Homo Sapiens
LLGELALVI

SEQ ID NO: 1406613 - protein, 9 aa, Homo Sapiens
PTPLLASED

SEQ ID NO: 1406614 - protein, 9 aa, Homo Sapiens
AVVLQVGDL

SEQ ID NO: 1406615 - protein, 9 aa, Homo Sapiens
QVWTAATLR

SEQ ID NO: 1406616 - protein, 9 aa, Homo Sapiens
IVQFAYEDT

SEQ ID NO: 1406617 - protein, 9 aa, Homo Sapiens
NFQKNRILK

SEQ ID NO: 1406618 - protein, 9 aa, Homo Sapiens
NTRAQSGEA

SEQ ID NO: 1406619 - protein, 9 aa, Homo Sapiens
YEFQGEERI

SEQ ID NO: 1406620 - protein, 9 aa, Homo Sapiens
HIQQNAVQN

SEQ ID NO: 1406621 - protein, 9 aa, Homo Sapiens
EHTQMVAFD

SEQ ID NO: 1406622 - protein, 9 aa, Homo Sapiens
NKPYECKRC

SEQ ID NO: 1406623 - protein, 9 aa, Homo Sapiens
VDSSPKGSG

SEQ ID NO: 1406624 - protein, 9 aa, Homo Sapiens
EASEENNGQ

SEQ ID NO: 1406625 - protein, 9 aa, Homo Sapiens
NKYLDVISN

SEQ ID NO: 1406626 - protein, 9 aa, Homo Sapiens
VTQLTTMCE

SEQ ID NO: 1406627 - protein, 9 aa, Homo Sapiens
EFVLEMHFR

SEQ ID NO: 1406628 - protein, 9 aa, Homo Sapiens
FSECLIASS

SEQ ID NO: 1406629 - protein, 9 aa, Homo Sapiens
QYWNEDQPQ

SEQ ID NO: 1406630 - protein, 9 aa, Homo Sapiens
GLLCPALHL

SEQ ID NO: 1406631 - protein, 9 aa, Homo Sapiens
LAGNTSKDL

SEQ ID NO: 1406632 - protein, 9 aa, Homo Sapiens
NVESGGPHL

SEQ ID NO: 1406633 - protein, 9 aa, Homo Sapiens
GTPPPLILW

SEQ ID NO: 1406634 - protein, 9 aa, Homo Sapiens
EPTLLPMQE

SEQ ID NO: 1406635 - protein, 9 aa, Homo Sapiens
LEMHFRWEN

SEQ ID NO: 1406636 - protein, 9 aa, Homo Sapiens
RCISQTEGD

SEQ ID NO: 1406637 - protein, 9 aa, Homo Sapiens
LHHQLSDPN

SEQ ID NO: 1406638 - protein, 9 aa, Homo Sapiens
HTVRKQTLN

SEQ ID NO: 1406639 - protein, 9 aa, Homo Sapiens
SMDVLASLK

SEQ ID NO: 1406640 - protein, 9 aa, Homo Sapiens
SSITSSIHD

SEQ ID NO: 1406641 - protein, 9 aa, Homo Sapiens
LHWRIGGGT

SEQ ID NO: 1406642 - protein, 9 aa, Homo Sapiens
QVCALEELC

SEQ ID NO: 1406643 - protein, 9 aa, Homo Sapiens
CCSDMATTF

SEQ ID NO: 1406644 - protein, 9 aa, Homo Sapiens
TSYNDSARR

SEQ ID NO: 1406645 - protein, 9 aa, Homo Sapiens
LIKQNNSYC

SEQ ID NO: 1406646 - protein, 9 aa, Homo Sapiens
PRGLLCPAL

SEQ ID NO: 1406647 - protein, 9 aa, Homo Sapiens
SENFYSDLN

SEQ ID NO: 1406648 - protein, 9 aa, Homo Sapiens
RVLRRMVPH

SEQ ID NO: 1406649 - protein, 9 aa, Homo Sapiens
LMAMFQATS

SEQ ID NO: 1406650 - protein, 9 aa, Homo Sapiens
TSSCWGLVL

SEQ ID NO: 1406651 - protein, 9 aa, Homo Sapiens
RFCSQLLTF

SEQ ID NO: 1406652 - protein, 9 aa, Homo Sapiens
NCSHFPTPL

SEQ ID NO: 1406653 - protein, 9 aa, Homo Sapiens
VQFAYEDTK

SEQ ID NO: 1406654 - protein, 9 aa, Homo Sapiens
GPAAPLAPP

SEQ ID NO: 1406655 - protein, 9 aa, Homo Sapiens
RCRHHERCS

SEQ ID NO: 1406656 - protein, 9 aa, Homo Sapiens
LEDIKRFAS

SEQ ID NO: 1406657 - protein, 9 aa, Homo Sapiens
LYVTLQAAA

SEQ ID NO: 1406658 - protein, 9 aa, Homo Sapiens
GGEQVCALE

SEQ ID NO: 1406659 - protein, 9 aa, Homo Sapiens
SQSRCSIAF

SEQ ID NO: 1406660 - protein, 9 aa, Homo Sapiens
SALYVTLQA

SEQ ID NO: 1406661 - protein, 9 aa, Homo Sapiens
TPKREDAMK

SEQ ID NO: 1406662 - protein, 9 aa, Homo Sapiens
CLLSTRSLG

SEQ ID NO: 1406663 - protein, 9 aa, Homo Sapiens
FCSQLLTFD

SEQ ID NO: 1406664 - protein, 9 aa, Homo Sapiens
ALAEKTSHI

SEQ ID NO: 1406665 - protein, 9 aa, Homo Sapiens
ARFSTASLA

SEQ ID NO: 1406666 - protein, 9 aa, Homo Sapiens
TYSALWSSS

SEQ ID NO: 1406667 - protein, 9 aa, Homo Sapiens
NPHGTLPSR

SEQ ID NO: 1406668 - protein, 9 aa, Homo Sapiens
MHFRWENNF

SEQ ID NO: 1406669 - protein, 9 aa, Homo Sapiens
NCDMSHGQE

SEQ ID NO: 1406670 - protein, 9 aa, Homo Sapiens
AGNTSKDLK

SEQ ID NO: 1406671 - protein, 9 aa, Homo Sapiens
SKRDTEGGW

SEQ ID NO: 1406672 - protein, 9 aa, Homo Sapiens
KNPEHHPGV

SEQ ID NO: 1406673 - protein, 9 aa, Homo Sapiens
ASLAKELTH

SEQ ID NO: 1406674 - protein, 9 aa, Homo Sapiens
THPAHQPLG

SEQ ID NO: 1406675 - protein, 9 aa, Homo Sapiens
AVALLADLG

SEQ ID NO: 1406676 - protein, 9 aa, Homo Sapiens
HQNLDPTSS

SEQ ID NO: 1406677 - protein, 9 aa, Homo Sapiens
LANLKFANS

SEQ ID NO: 1406678 - protein, 9 aa, Homo Sapiens
GAVHGQQSL

SEQ ID NO: 1406679 - protein, 9 aa, Homo Sapiens
GNRQWSTSK

SEQ ID NO: 1406680 - protein, 9 aa, Homo Sapiens
VSDNAPLTS

SEQ ID NO: 1406681 - protein, 9 aa, Homo Sapiens
NMAKLGKVS

SEQ ID NO: 1406682 - protein, 9 aa, Homo Sapiens
KIRMYSLRP

SEQ ID NO: 1406683 - protein, 9 aa, Homo Sapiens
PLGDTPQPS

SEQ ID NO: 1406684 - protein, 9 aa, Homo Sapiens
LYVEESSWD

SEQ ID NO: 1406685 - protein, 9 aa, Homo Sapiens
SARCNLCLP

SEQ ID NO: 1406686 - protein, 9 aa, Homo Sapiens
AASVAASRV

SEQ ID NO: 1406687 - protein, 9 aa, Homo Sapiens
IHKTFEINQ

SEQ ID NO: 1406688 - protein, 9 aa, Homo Sapiens
MWLYLDHNH

SEQ ID NO: 1406689 - protein, 9 aa, Homo Sapiens
PAAPLAPPA

SEQ ID NO: 1406690 - protein, 9 aa, Homo Sapiens
CGPCWNTST

SEQ ID NO: 1406691 - protein, 9 aa, Homo Sapiens
LVVPAGKGV

SEQ ID NO: 1406692 - protein, 9 aa, Homo Sapiens
VQVGKEMEP

SEQ ID NO: 1406693 - protein, 9 aa, Homo Sapiens
VLEMHFRWE

SEQ ID NO: 1406694 - protein, 9 aa, Homo Sapiens
HEPTLLPMQ

SEQ ID NO: 1406695 - protein, 9 aa, Homo Sapiens
LGLLGIISV

SEQ ID NO: 1406696 - protein, 9 aa, Homo Sapiens
TINGSNLPR

SEQ ID NO: 1406697 - protein, 9 aa, Homo Sapiens
SDFSNNWNS

SEQ ID NO: 1406698 - protein, 9 aa, Homo Sapiens
VMVARMLLE

SEQ ID NO: 1406699 - protein, 9 aa, Homo Sapiens
GIKVHDIRL

SEQ ID NO: 1406700 - protein, 9 aa, Homo Sapiens
VTMHREDLV

SEQ ID NO: 1406701 - protein, 9 aa, Homo Sapiens
PCASLLSTL

SEQ ID NO: 1406702 - protein, 9 aa, Homo Sapiens
MASYIYCFM

SEQ ID NO: 1406703 - protein, 9 aa, Homo Sapiens
TNITTPKRE

SEQ ID NO: 1406704 - protein, 9 aa, Homo Sapiens
SYNDSARRK

SEQ ID NO: 1406705 - protein, 9 aa, Homo Sapiens
SIRSLPPTV

SEQ ID NO: 1406706 - protein, 9 aa, Homo Sapiens
LAIRIDSHL

SEQ ID NO: 1406707 - protein, 9 aa, Homo Sapiens
ENMKSEMAH

SEQ ID NO: 1406708 - protein, 9 aa, Homo Sapiens
GNTSKDLKV

SEQ ID NO: 1406709 - protein, 9 aa, Homo Sapiens
RKNMRPVDM

SEQ ID NO: 1406710 - protein, 9 aa, Homo Sapiens
ISQTEGDLP

SEQ ID NO: 1406711 - protein, 9 aa, Homo Sapiens
REIMLEEPS

SEQ ID NO: 1406712 - protein, 9 aa, Homo Sapiens
HRIKFEEKN

SEQ ID NO: 1406713 - protein, 9 aa, Homo Sapiens
MHREDLVVP

SEQ ID NO: 1406714 - protein, 9 aa, Homo Sapiens
RPYLCWECG

SEQ ID NO: 1406715 - protein, 9 aa, Homo Sapiens
NTTASVTLN

SEQ ID NO: 1406716 - protein, 9 aa, Homo Sapiens
YNTGLYPLT

SEQ ID NO: 1406717 - protein, 9 aa, Homo Sapiens
LIFPVTVII

SEQ ID NO: 1406718 - protein, 9 aa, Homo Sapiens
GQHMTFPPE

SEQ ID NO: 1406719 - protein, 9 aa, Homo Sapiens
LSVNVTAST

SEQ ID NO: 1406720 - protein, 9 aa, Homo Sapiens
PSQSRCSIA

SEQ ID NO: 1406721 - protein, 9 aa, Homo Sapiens
RKNAFHHTV

SEQ ID NO: 1406722 - protein, 9 aa, Homo Sapiens
KTKNFLFGR

SEQ ID NO: 1406723 - protein, 9 aa, Homo Sapiens
LSISRPTSR

SEQ ID NO: 1406724 - protein, 9 aa, Homo Sapiens
DNVNYFILE

SEQ ID NO: 1406725 - protein, 9 aa, Homo Sapiens
PVQVAEALT

SEQ ID NO: 1406726 - protein, 9 aa, Homo Sapiens
NTEECITLE

SEQ ID NO: 1406727 - protein, 9 aa, Homo Sapiens
PAGIICVAD

SEQ ID NO: 1406728 - protein, 9 aa, Homo Sapiens
VTSTIHLTF

SEQ ID NO: 1406729 - protein, 9 aa, Homo Sapiens
LSTLSQPPP

SEQ ID NO: 1406730 - protein, 9 aa, Homo Sapiens
KSALANLKF

SEQ ID NO: 1406731 - protein, 9 aa, Homo Sapiens
ALSFSGPRE

SEQ ID NO: 1406732 - protein, 9 aa, Homo Sapiens
CYGYYPCFW

SEQ ID NO: 1406733 - protein, 9 aa, Homo Sapiens
KGSGTEDNL

SEQ ID NO: 1406734 - protein, 9 aa, Homo Sapiens
KLLVTPPRP

SEQ ID NO: 1406735 - protein, 9 aa, Homo Sapiens
SSQECLQSR

SEQ ID NO: 1406736 - protein, 9 aa, Homo Sapiens
SVMVYDRFV

SEQ ID NO: 1406737 - protein, 9 aa, Homo Sapiens
HVSTNLKTL

SEQ ID NO: 1406738 - protein, 9 aa, Homo Sapiens
EAHLKELAC

SEQ ID NO: 1406739 - protein, 9 aa, Homo Sapiens
SESPELHQK

SEQ ID NO: 1406740 - protein, 9 aa, Homo Sapiens
EDVSDNAPL

SEQ ID NO: 1406741 - protein, 9 aa, Homo Sapiens
PLSLYRNMA

SEQ ID NO: 1406742 - protein, 9 aa, Homo Sapiens
GSVDSLVEA

SEQ ID NO: 1406743 - protein, 9 aa, Homo Sapiens
NAFHHTVRK

SEQ ID NO: 1406744 - protein, 9 aa, Homo Sapiens
NPDRELQPW

SEQ ID NO: 1406745 - protein, 9 aa, Homo Sapiens
LPSQSRCSI

SEQ ID NO: 1406746 - protein, 9 aa, Homo Sapiens
KQTLNFHFW

SEQ ID NO: 1406747 - protein, 9 aa, Homo Sapiens
ISARCNLCL

SEQ ID NO: 1406748 - protein, 9 aa, Homo Sapiens
HYLPTSLKN

SEQ ID NO: 1406749 - protein, 9 aa, Homo Sapiens
KTWFRSNPT

SEQ ID NO: 1406750 - protein, 9 aa, Homo Sapiens
GKRGSVDSL

SEQ ID NO: 1406751 - protein, 9 aa, Homo Sapiens
CIVCSCIEG

SEQ ID NO: 1406752 - protein, 9 aa, Homo Sapiens
ARKKPAASP

SEQ ID NO: 1406753 - protein, 9 aa, Homo Sapiens
QEEIVQVGK

SEQ ID NO: 1406754 - protein, 9 aa, Homo Sapiens
FTGLMQLMW

SEQ ID NO: 1406755 - protein, 9 aa, Homo Sapiens
SLIIFTIRS

SEQ ID NO: 1406756 - protein, 9 aa, Homo Sapiens
ATAEKFKVP

SEQ ID NO: 1406757 - protein, 9 aa, Homo Sapiens
PSPTSSCWG

SEQ ID NO: 1406758 - protein, 9 aa, Homo Sapiens
EGVDFEITS

SEQ ID NO: 1406759 - protein, 9 aa, Homo Sapiens
LCRELHPRY

SEQ ID NO: 1406760 - protein, 9 aa, Homo Sapiens
MYLLITGPN

SEQ ID NO: 1406761 - protein, 9 aa, Homo Sapiens
NLPMHKTIN

SEQ ID NO: 1406762 - protein, 9 aa, Homo Sapiens
AFKGIAQRT

SEQ ID NO: 1406763 - protein, 9 aa, Homo Sapiens
APHILTGAT

SEQ ID NO: 1406764 - protein, 9 aa, Homo Sapiens
KLLIVKCPH

SEQ ID NO: 1406765 - protein, 9 aa, Homo Sapiens
LCPALHLVK

SEQ ID NO: 1406766 - protein, 9 aa, Homo Sapiens
DPYHAYVCS

SEQ ID NO: 1406767 - protein, 9 aa, Homo Sapiens
VADHGKSHV

SEQ ID NO: 1406768 - protein, 9 aa, Homo Sapiens
LHQKSPLFQ

SEQ ID NO: 1406769 - protein, 9 aa, Homo Sapiens
TAVLKPESG

SEQ ID NO: 1406770 - protein, 9 aa, Homo Sapiens
YVTLQAAAR

SEQ ID NO: 1406771 - protein, 9 aa, Homo Sapiens
CKAYLPWSY

SEQ ID NO: 1406772 - protein, 9 aa, Homo Sapiens
YHSDTPTTH

SEQ ID NO: 1406773 - protein, 9 aa, Homo Sapiens
IHERIHTSN

SEQ ID NO: 1406774 - protein, 9 aa, Homo Sapiens
GPVQVAEAL

SEQ ID NO: 1406775 - protein, 9 aa, Homo Sapiens
NRILKQMLP

SEQ ID NO: 1406776 - protein, 9 aa, Homo Sapiens
PAHQPLGSM

SEQ ID NO: 1406777 - protein, 9 aa, Homo Sapiens
STDPELRRP

SEQ ID NO: 1406778 - protein, 9 aa, Homo Sapiens
LLVYTLTIV

SEQ ID NO: 1406779 - protein, 9 aa, Homo Sapiens
PRVLHQNLD

SEQ ID NO: 1406780 - protein, 9 aa, Homo Sapiens
RVEEGMYLL

SEQ ID NO: 1406781 - protein, 9 aa, Homo Sapiens
AAFFLTTLL

SEQ ID NO: 1406782 - protein, 9 aa, Homo Sapiens
HEFGHVIGF

SEQ ID NO: 1406783 - protein, 9 aa, Homo Sapiens
STRSLGSLP

SEQ ID NO: 1406784 - protein, 9 aa, Homo Sapiens
EPTPRGMPY

SEQ ID NO: 1406785 - protein, 9 aa, Homo Sapiens
VNVPKKNSR

SEQ ID NO: 1406786 - protein, 9 aa, Homo Sapiens
VPDLRHICG

SEQ ID NO: 1406787 - protein, 9 aa, Homo Sapiens
PNVWVNYDF

SEQ ID NO: 1406788 - protein, 9 aa, Homo Sapiens
TSIGNPIHI

SEQ ID NO: 1406789 - protein, 9 aa, Homo Sapiens
MATLYCDPD

SEQ ID NO: 1406790 - protein, 9 aa, Homo Sapiens
PTPRGMPYH

SEQ ID NO: 1406791 - protein, 9 aa, Homo Sapiens
RKALSFNHS

SEQ ID NO: 1406792 - protein, 9 aa, Homo Sapiens
VPQLKQEFS

SEQ ID NO: 1406793 - protein, 9 aa, Homo Sapiens
RNPDRELQP

SEQ ID NO: 1406794 - protein, 9 aa, Homo Sapiens
YRNMAKLGK

SEQ ID NO: 1406795 - protein, 9 aa, Homo Sapiens
TIVEAHLKE

SEQ ID NO: 1406796 - protein, 9 aa, Homo Sapiens
RIKFEEKNI

SEQ ID NO: 1406797 - protein, 9 aa, Homo Sapiens
IVADHGKSH

SEQ ID NO: 1406798 - protein, 9 aa, Homo Sapiens
HKATAEKFK

SEQ ID NO: 1406799 - protein, 9 aa, Homo Sapiens
RRRPQPNKS

SEQ ID NO: 1406800 - protein, 9 aa, Homo Sapiens
GGPHLLQPA

SEQ ID NO: 1406801 - protein, 9 aa, Homo Sapiens
NLDNYLFFL

SEQ ID NO: 1406802 - protein, 9 aa, Homo Sapiens
QVAEALTLP

SEQ ID NO: 1406803 - protein, 9 aa, Homo Sapiens
KRKNMRPVD

SEQ ID NO: 1406804 - protein, 9 aa, Homo Sapiens
MAPPASWAP

SEQ ID NO: 1406805 - protein, 9 aa, Homo Sapiens
GWMLNQFFL

SEQ ID NO: 1406806 - protein, 9 aa, Homo Sapiens
DHQTPQPHL

SEQ ID NO: 1406807 - protein, 9 aa, Homo Sapiens
IEVEDVSDN

SEQ ID NO: 1406808 - protein, 9 aa, Homo Sapiens
SLTINGSNL

SEQ ID NO: 1406809 - protein, 9 aa, Homo Sapiens
TSQPEMPTS

SEQ ID NO: 1406810 - protein, 9 aa, Homo Sapiens
YSDLNSEQM

SEQ ID NO: 1406811 - protein, 9 aa, Homo Sapiens
GDTGARDPE

SEQ ID NO: 1406812 - protein, 9 aa, Homo Sapiens
SLYRNMAKL

SEQ ID NO: 1406813 - protein, 9 aa, Homo Sapiens
IFQNHRIKF

SEQ ID NO: 1406814 - protein, 9 aa, Homo Sapiens
KESFAQKNI

SEQ ID NO: 1406815 - protein, 9 aa, Homo Sapiens
PEHHPGVTM

SEQ ID NO: 1406816 - protein, 9 aa, Homo Sapiens
ESLQEKSQG

SEQ ID NO: 1406817 - protein, 9 aa, Homo Sapiens
SSLLDFMLR

SEQ ID NO: 1406818 - protein, 9 aa, Homo Sapiens
GSNTSSLIG

SEQ ID NO: 1406819 - protein, 9 aa, Homo Sapiens
IHPIYEPKD

SEQ ID NO: 1406820 - protein, 9 aa, Homo Sapiens
DDTPRRGWP

SEQ ID NO: 1406821 - protein, 9 aa, Homo Sapiens
PAEATALSF

SEQ ID NO: 1406822 - protein, 9 aa, Homo Sapiens
CRHHERCSD

SEQ ID NO: 1406823 - protein, 9 aa, Homo Sapiens
PELHQKSPL

SEQ ID NO: 1406824 - protein, 9 aa, Homo Sapiens
GKFGRCISQ

SEQ ID NO: 1406825 - protein, 9 aa, Homo Sapiens
PVTVIILSY

SEQ ID NO: 1406826 - protein, 9 aa, Homo Sapiens
ASSEHTQMV

SEQ ID NO: 1406827 - protein, 9 aa, Homo Sapiens
NKSAVIPDY

SEQ ID NO: 1406828 - protein, 9 aa, Homo Sapiens
LDICFTISL

SEQ ID NO: 1406829 - protein, 9 aa, Homo Sapiens
VMFLMYLLA

SEQ ID NO: 1406830 - protein, 9 aa, Homo Sapiens
VNDINDNPP

SEQ ID NO: 1406831 - protein, 9 aa, Homo Sapiens
TSNKPYECK

SEQ ID NO: 1406832 - protein, 9 aa, Homo Sapiens
LAFTAHQTH

SEQ ID NO: 1406833 - protein, 9 aa, Homo Sapiens
CVEGVEGPH

SEQ ID NO: 1406834 - protein, 9 aa, Homo Sapiens
GGMSRTPPR

SEQ ID NO: 1406835 - protein, 9 aa, Homo Sapiens
NTLTCRDCQ

SEQ ID NO: 1406836 - protein, 9 aa, Homo Sapiens
FEIQYKKDT

SEQ ID NO: 1406837 - protein, 9 aa, Homo Sapiens
WCFPTQARA

SEQ ID NO: 1406838 - protein, 9 aa, Homo Sapiens
YHQSAPHIL

SEQ ID NO: 1406839 - protein, 9 aa, Homo Sapiens
GPSWRMRRS

SEQ ID NO: 1406840 - protein, 9 aa, Homo Sapiens
WGLVLPTCL

SEQ ID NO: 1406841 - protein, 9 aa, Homo Sapiens
PACSPPAPT

SEQ ID NO: 1406842 - protein, 9 aa, Homo Sapiens
QWEARKKPA

SEQ ID NO: 1406843 - protein, 9 aa, Homo Sapiens
QVLDLHHGL

SEQ ID NO: 1406844 - protein, 9 aa, Homo Sapiens
TKNPLAMYP

SEQ ID NO: 1406845 - protein, 9 aa, Homo Sapiens
TPPPLILWP

SEQ ID NO: 1406846 - protein, 9 aa, Homo Sapiens
TYDNPDFNY

SEQ ID NO: 1406847 - protein, 9 aa, Homo Sapiens
NKIKIVGLR

SEQ ID NO: 1406848 - protein, 9 aa, Homo Sapiens
SPLLQDGGS

SEQ ID NO: 1406849 - protein, 9 aa, Homo Sapiens
IVNVPKKNS

SEQ ID NO: 1406850 - protein, 9 aa, Homo Sapiens
LKTEIDKLA

SEQ ID NO: 1406851 - protein, 9 aa, Homo Sapiens
AEALTLPQF

SEQ ID NO: 1406852 - protein, 9 aa, Homo Sapiens
QHKLPAQKT

SEQ ID NO: 1406853 - protein, 9 aa, Homo Sapiens
RPIRPPFLE

SEQ ID NO: 1406854 - protein, 9 aa, Homo Sapiens
DSSPKGSGT

SEQ ID NO: 1406855 - protein, 9 aa, Homo Sapiens
DKDPTEWRF

SEQ ID NO: 1406856 - protein, 9 aa, Homo Sapiens
RHEPTLLPM

SEQ ID NO: 1406857 - protein, 9 aa, Homo Sapiens
IFPVTVIIL

SEQ ID NO: 1406858 - protein, 9 aa, Homo Sapiens
VSASRDRTV

SEQ ID NO: 1406859 - protein, 9 aa, Homo Sapiens
PSAAQKMKK

SEQ ID NO: 1406860 - protein, 9 aa, Homo Sapiens
YPCFWGSDN

SEQ ID NO: 1406861 - protein, 9 aa, Homo Sapiens
SHVTLHATA

SEQ ID NO: 1406862 - protein, 9 aa, Homo Sapiens
EATALSFSG

SEQ ID NO: 1406863 - protein, 9 aa, Homo Sapiens
LCWECGKLF

SEQ ID NO: 1406864 - protein, 9 aa, Homo Sapiens
SCCLPGLTH

SEQ ID NO: 1406865 - protein, 9 aa, Homo Sapiens
MTKNPLAMY

SEQ ID NO: 1406866 - protein, 9 aa, Homo Sapiens
GEKPQIFTK

SEQ ID NO: 1406867 - protein, 9 aa, Homo Sapiens
SQLKIEDAD

SEQ ID NO: 1406868 - protein, 9 aa, Homo Sapiens
GGTYSPQDT

SEQ ID NO: 1406869 - protein, 9 aa, Homo Sapiens
LPNVWVNYD

SEQ ID NO: 1406870 - protein, 9 aa, Homo Sapiens
EGGVQVLDL

SEQ ID NO: 1406871 - protein, 9 aa, Homo Sapiens
RLSSCCLLS

SEQ ID NO: 1406872 - protein, 9 aa, Homo Sapiens
NRLMITHHV

SEQ ID NO: 1406873 - protein, 9 aa, Homo Sapiens
RFCRAGYLV

SEQ ID NO: 1406874 - protein, 9 aa, Homo Sapiens
AHLKELACP

SEQ ID NO: 1406875 - protein, 9 aa, Homo Sapiens
RKLYQFLHL

SEQ ID NO: 1406876 - protein, 9 aa, Homo Sapiens
ALANLKFAN

SEQ ID NO: 1406877 - protein, 9 aa, Homo Sapiens
FSLKLCIYF

SEQ ID NO: 1406878 - protein, 9 aa, Homo Sapiens
AAQKMKKAH

SEQ ID NO: 1406879 - protein, 9 aa, Homo Sapiens
QNHRIKFEE

SEQ ID NO: 1406880 - protein, 9 aa, Homo Sapiens
SQLLTFDIG

SEQ ID NO: 1406881 - protein, 9 aa, Homo Sapiens
GHHHRPRPI

SEQ ID NO: 1406882 - protein, 9 aa, Homo Sapiens
QAVGVADLG

SEQ ID NO: 1406883 - protein, 9 aa, Homo Sapiens
CHLQVVEAS

SEQ ID NO: 1406884 - protein, 9 aa, Homo Sapiens
TWFRSNPTK

SEQ ID NO: 1406885 - protein, 9 aa, Homo Sapiens
GPVQSCSQV

SEQ ID NO: 1406886 - protein, 9 aa, Homo Sapiens
HVSPAGIIC

SEQ ID NO: 1406887 - protein, 9 aa, Homo Sapiens
ECYLLSVMV

SEQ ID NO: 1406888 - protein, 9 aa, Homo Sapiens
IRNFQKNRI

SEQ ID NO: 1406889 - protein, 9 aa, Homo Sapiens
IRSLPPTVT

SEQ ID NO: 1406890 - protein, 9 aa, Homo Sapiens
IFTNTFIID

SEQ ID NO: 1406891 - protein, 9 aa, Homo Sapiens
IRVEEGMYL

SEQ ID NO: 1406892 - protein, 9 aa, Homo Sapiens
PKNAFMVWS

SEQ ID NO: 1406893 - protein, 9 aa, Homo Sapiens
SVTITGQHM

SEQ ID NO: 1406894 - protein, 9 aa, Homo Sapiens
QVHKATAEK

SEQ ID NO: 1406895 - protein, 9 aa, Homo Sapiens
LIVKCPHIQ

SEQ ID NO: 1406896 - protein, 9 aa, Homo Sapiens
FFLFGEIPG

SEQ ID NO: 1406897 - protein, 9 aa, Homo Sapiens
ECIEPVHNL

SEQ ID NO: 1406898 - protein, 9 aa, Homo Sapiens
ARCNLCLPD

SEQ ID NO: 1406899 - protein, 9 aa, Homo Sapiens
TIATDTAAA

SEQ ID NO: 1406900 - protein, 9 aa, Homo Sapiens
NTHIFRHQK

SEQ ID NO: 1406901 - protein, 9 aa, Homo Sapiens
CASLLSTLS

SEQ ID NO: 1406902 - protein, 9 aa, Homo Sapiens
LTSMYQNSS

SEQ ID NO: 1406903 - protein, 9 aa, Homo Sapiens
ELTHPLLVS

SEQ ID NO: 1406904 - protein, 9 aa, Homo Sapiens
PGNSLIIFT

SEQ ID NO: 1406905 - protein, 9 aa, Homo Sapiens
FLMAMFQAT

SEQ ID NO: 1406906 - protein, 9 aa, Homo Sapiens
GIVVHEFGH

SEQ ID NO: 1406907 - protein, 9 aa, Homo Sapiens
HKLPAQKTA

SEQ ID NO: 1406908 - protein, 9 aa, Homo Sapiens
KTINTDLSR

SEQ ID NO: 1406909 - protein, 9 aa, Homo Sapiens
YVPPLPNVW

SEQ ID NO: 1406910 - protein, 9 aa, Homo Sapiens
GKGVGGGAG

SEQ ID NO: 1406911 - protein, 9 aa, Homo Sapiens
SQCTTLYVE

SEQ ID NO: 1406912 - protein, 9 aa, Homo Sapiens
PEIRLSSCC

SEQ ID NO: 1406913 - protein, 9 aa, Homo Sapiens
LLDYFHHWP

SEQ ID NO: 1406914 - protein, 9 aa, Homo Sapiens
PPPLILWPQ

SEQ ID NO: 1406915 - protein, 9 aa, Homo Sapiens
LKQEFSECL

SEQ ID NO: 1406916 - protein, 9 aa, Homo Sapiens
DIPSIHPIY

SEQ ID NO: 1406917 - protein, 9 aa, Homo Sapiens
ECYESYTLN

SEQ ID NO: 1406918 - protein, 9 aa, Homo Sapiens
KTPFLNSQV

SEQ ID NO: 1406919 - protein, 9 aa, Homo Sapiens
LSVMVYDRF

SEQ ID NO: 1406920 - protein, 9 aa, Homo Sapiens
PQAPSQVWT

SEQ ID NO: 1406921 - protein, 9 aa, Homo Sapiens
KNAFMVWSK

SEQ ID NO: 1406922 - protein, 9 aa, Homo Sapiens
APEIRLSSC

SEQ ID NO: 1406923 - protein, 9 aa, Homo Sapiens
CGMAHRDSL

SEQ ID NO: 1406924 - protein, 9 aa, Homo Sapiens
SLHHQLSDP

SEQ ID NO: 1406925 - protein, 9 aa, Homo Sapiens
PCWNTSTPA

SEQ ID NO: 1406926 - protein, 9 aa, Homo Sapiens
ASLLSTLSQ

SEQ ID NO: 1406927 - protein, 9 aa, Homo Sapiens
DPEWWLQHP

SEQ ID NO: 1406928 - protein, 9 aa, Homo Sapiens
KLTKQSGHT

SEQ ID NO: 1406929 - protein, 9 aa, Homo Sapiens
DEFLMGGMS

SEQ ID NO: 1406930 - protein, 9 aa, Homo Sapiens
MAGMPGTAC

SEQ ID NO: 1406931 - protein, 9 aa, Homo Sapiens
TLLLALPIT

SEQ ID NO: 1406932 - protein, 9 aa, Homo Sapiens
QSRCSIAFP

SEQ ID NO: 1406933 - protein, 9 aa, Homo Sapiens
ERFVRKKVI

SEQ ID NO: 1406934 - protein, 9 aa, Homo Sapiens
TVFGKRILD

SEQ ID NO: 1406935 - protein, 9 aa, Homo Sapiens
LWRAPPGRW

SEQ ID NO: 1406936 - protein, 9 aa, Homo Sapiens
TKNFLFGRS

SEQ ID NO: 1406937 - protein, 9 aa, Homo Sapiens
KCDKSSKRD

SEQ ID NO: 1406938 - protein, 9 aa, Homo Sapiens
MVDEDVTGA

SEQ ID NO: 1406939 - protein, 9 aa, Homo Sapiens
VMVYDRFVA

SEQ ID NO: 1406940 - protein, 9 aa, Homo Sapiens
FVMFLMYLL

SEQ ID NO: 1406941 - protein, 9 aa, Homo Sapiens
LRTVVEKLR

SEQ ID NO: 1406942 - protein, 9 aa, Homo Sapiens
AVGVADLGR

SEQ ID NO: 1406943 - protein, 9 aa, Homo Sapiens
DQQECPRKN

SEQ ID NO: 1406944 - protein, 9 aa, Homo Sapiens
IKQNNSYCR

SEQ ID NO: 1406945 - protein, 9 aa, Homo Sapiens
RPPFLESKQ

SEQ ID NO: 1406946 - protein, 9 aa, Homo Sapiens
HFPTPLLAS

SEQ ID NO: 1406947 - protein, 9 aa, Homo Sapiens
LQEHNLDNY

SEQ ID NO: 1406948 - protein, 9 aa, Homo Sapiens
IPGRIICID

SEQ ID NO: 1406949 - protein, 9 aa, Homo Sapiens
VSYIKVVHV

SEQ ID NO: 1406950 - protein, 9 aa, Homo Sapiens
SKKTPFLNS

SEQ ID NO: 1406951 - protein, 9 aa, Homo Sapiens
GDTPQPSLP

SEQ ID NO: 1406952 - protein, 9 aa, Homo Sapiens
PANEAHVST

SEQ ID NO: 1406953 - protein, 9 aa, Homo Sapiens
NPDVSYERS

SEQ ID NO: 1406954 - protein, 9 aa, Homo Sapiens
SFAQKNILL

SEQ ID NO: 1406955 - protein, 9 aa, Homo Sapiens
PAYQQGQKQ

SEQ ID NO: 1406956 - protein, 9 aa, Homo Sapiens
VEDVSDNAP

SEQ ID NO: 1406957 - protein, 9 aa, Homo Sapiens
GMAGAAIDT

SEQ ID NO: 1406958 - protein, 9 aa, Homo Sapiens
SPTSSCWGL

SEQ ID NO: 1406959 - protein, 9 aa, Homo Sapiens
ENSSWTMTF

SEQ ID NO: 1406960 - protein, 9 aa, Homo Sapiens
DMATTFNGL

SEQ ID NO: 1406961 - protein, 9 aa, Homo Sapiens
NVWVNYDFG

SEQ ID NO: 1406962 - protein, 9 aa, Homo Sapiens
FSKWCRPWL

SEQ ID NO: 1406963 - protein, 9 aa, Homo Sapiens
CSLQCSVAW

SEQ ID NO: 1406964 - protein, 9 aa, Homo Sapiens
VDVEVNDIN

SEQ ID NO: 1406965 - protein, 9 aa, Homo Sapiens
SEDIHKTFE

SEQ ID NO: 1406966 - protein, 9 aa, Homo Sapiens
GDLQAVGVA

SEQ ID NO: 1406967 - protein, 9 aa, Homo Sapiens
LEQMLHSCR

SEQ ID NO: 1406968 - protein, 9 aa, Homo Sapiens
WIAVRHEPT

SEQ ID NO: 1406969 - protein, 9 aa, Homo Sapiens
HLQVVEASS

SEQ ID NO: 1406970 - protein, 9 aa, Homo Sapiens
WECKAYLPW

SEQ ID NO: 1406971 - protein, 9 aa, Homo Sapiens
LNFHFWTRG

SEQ ID NO: 1406972 - protein, 9 aa, Homo Sapiens
GNPLLEQLK

SEQ ID NO: 1406973 - protein, 9 aa, Homo Sapiens
PTQARAACG

SEQ ID NO: 1406974 - protein, 9 aa, Homo Sapiens
SKEIDEKER

SEQ ID NO: 1406975 - protein, 9 aa, Homo Sapiens
RRIKNPEHH

SEQ ID NO: 1406976 - protein, 9 aa, Homo Sapiens
DSYPVVNRI

SEQ ID NO: 1406977 - protein, 9 aa, Homo Sapiens
WPHKMASYI

SEQ ID NO: 1406978 - protein, 9 aa, Homo Sapiens
PSWRMRRSR

SEQ ID NO: 1406979 - protein, 9 aa, Homo Sapiens
PPRPCSSPS

SEQ ID NO: 1406980 - protein, 9 aa, Homo Sapiens
VNRINEPLV

SEQ ID NO: 1406981 - protein, 9 aa, Homo Sapiens
APAYQQGQK

SEQ ID NO: 1406982 - protein, 9 aa, Homo Sapiens
RGDVGMAGA

SEQ ID NO: 1406983 - protein, 9 aa, Homo Sapiens
QKSDFSNNW

SEQ ID NO: 1406984 - protein, 9 aa, Homo Sapiens
LELAGNTSK

SEQ ID NO: 1406985 - protein, 9 aa, Homo Sapiens
SYIKVVHVT

SEQ ID NO: 1406986 - protein, 9 aa, Homo Sapiens
IYEPKDCYL

SEQ ID NO: 1406987 - protein, 9 aa, Homo Sapiens
INGSNTSSL

SEQ ID NO: 1406988 - protein, 9 aa, Homo Sapiens
ANTVRSPAD

SEQ ID NO: 1406989 - protein, 9 aa, Homo Sapiens
SFCQHKLPA

SEQ ID NO: 1406990 - protein, 9 aa, Homo Sapiens
LPTSLKNMV

SEQ ID NO: 1406991 - protein, 9 aa, Homo Sapiens
EIISKKTPF

SEQ ID NO: 1406992 - protein, 9 aa, Homo Sapiens
QIAYSATNI

SEQ ID NO: 1406993 - protein, 9 aa, Homo Sapiens
FVMVARMLL

SEQ ID NO: 1406994 - protein, 9 aa, Homo Sapiens
KEIDEKERR

SEQ ID NO: 1406995 - protein, 9 aa, Homo Sapiens
LQPWCFTTD

SEQ ID NO: 1406996 - protein, 9 aa, Homo Sapiens
KDQYWNEDQ

SEQ ID NO: 1406997 - protein, 9 aa, Homo Sapiens
SWAPQMRAA

SEQ ID NO: 1406998 - protein, 9 aa, Homo Sapiens
PHIHLGTYG

SEQ ID NO: 1406999 - protein, 9 aa, Homo Sapiens
FQCDPGYEF

SEQ ID NO: 1407000 - protein, 9 aa, Homo Sapiens
GGAGVLPDR

SEQ ID NO: 1407001 - protein, 9 aa, Homo Sapiens
TLSFCQHKL

SEQ ID NO: 1407002 - protein, 9 aa, Homo Sapiens
HTRKRPYLC

SEQ ID NO: 1407003 - protein, 9 aa, Homo Sapiens
QEPLNEVNN

SEQ ID NO: 1407004 - protein, 9 aa, Homo Sapiens
PGHHDPPPM

SEQ ID NO: 1407005 - protein, 9 aa, Homo Sapiens
EQVCALEEL

SEQ ID NO: 1407006 - protein, 9 aa, Homo Sapiens
KWCRPWLEQ

SEQ ID NO: 1407007 - protein, 9 aa, Homo Sapiens
KVCLLSTRS

SEQ ID NO: 1407008 - protein, 9 aa, Homo Sapiens
QPWCFTTDP

SEQ ID NO: 1407009 - protein, 9 aa, Homo Sapiens
VWDPIAAGG

SEQ ID NO: 1407010 - protein, 9 aa, Homo Sapiens
MIFSRVLRR

SEQ ID NO: 1407011 - protein, 9 aa, Homo Sapiens
FHHWPVFVE

SEQ ID NO: 1407012 - protein, 9 aa, Homo Sapiens
ATSQHQPWP

SEQ ID NO: 1407013 - protein, 9 aa, Homo Sapiens
SRCSIAFPL

SEQ ID NO: 1407014 - protein, 9 aa, Homo Sapiens
HGLGLLGII

SEQ ID NO: 1407015 - protein, 9 aa, Homo Sapiens
AEELVYETD

SEQ ID NO: 1407016 - protein, 9 aa, Homo Sapiens
ASYIYCFMA

SEQ ID NO: 1407017 - protein, 9 aa, Homo Sapiens
EIMLEEPSI

SEQ ID NO: 1407018 - protein, 9 aa, Homo Sapiens
GYYPCFWGS

SEQ ID NO: 1407019 - protein, 9 aa, Homo Sapiens
VHEFGHVIG

SEQ ID NO: 1407020 - protein, 9 aa, Homo Sapiens
PALHLVKPR

SEQ ID NO: 1407021 - protein, 9 aa, Homo Sapiens
QSGHTQTDY

SEQ ID NO: 1407022 - protein, 9 aa, Homo Sapiens
QEFSECLIA

SEQ ID NO: 1407023 - protein, 9 aa, Homo Sapiens
ESCNTLTCR

SEQ ID NO: 1407024 - protein, 9 aa, Homo Sapiens
CTTLYVEES

SEQ ID NO: 1407025 - protein, 9 aa, Homo Sapiens
CPRKNAFHH

SEQ ID NO: 1407026 - protein, 9 aa, Homo Sapiens
SQVWTAATL

SEQ ID NO: 1407027 - protein, 9 aa, Homo Sapiens
QEFVLEMHF

SEQ ID NO: 1407028 - protein, 9 aa, Homo Sapiens
LSFNHSLQA

SEQ ID NO: 1407029 - protein, 9 aa, Homo Sapiens
GLRMVEIGD

SEQ ID NO: 1407030 - protein, 9 aa, Homo Sapiens
KMASYIYCF

SEQ ID NO: 1407031 - protein, 9 aa, Homo Sapiens
RSCMTSQPE

SEQ ID NO: 1407032 - protein, 9 aa, Homo Sapiens
CFPTQARAA

SEQ ID NO: 1407033 - protein, 9 aa, Homo Sapiens
TACGMAHRD

SEQ ID NO: 1407034 - protein, 9 aa, Homo Sapiens
PFEDDTPRR

SEQ ID NO: 1407035 - protein, 9 aa, Homo Sapiens
PATKMATIA

SEQ ID NO: 1407036 - protein, 9 aa, Homo Sapiens
TKKARFSTA

SEQ ID NO: 1407037 - protein, 9 aa, Homo Sapiens
NTVRSPADS

SEQ ID NO: 1407038 - protein, 9 aa, Homo Sapiens
SPKGSGTED

SEQ ID NO: 1407039 - protein, 9 aa, Homo Sapiens
LYPLTAISV

SEQ ID NO: 1407040 - protein, 9 aa, Homo Sapiens
RKKPAASPH

SEQ ID NO: 1407041 - protein, 9 aa, Homo Sapiens
VSYICSRHY

SEQ ID NO: 1407042 - protein, 9 aa, Homo Sapiens
SQGALEEYV

SEQ ID NO: 1407043 - protein, 9 aa, Homo Sapiens
PTLLPMQED

SEQ ID NO: 1407044 - protein, 9 aa, Homo Sapiens
AATLRCPAV

SEQ ID NO: 1407045 - protein, 9 aa, Homo Sapiens
DGPVQVAEA

SEQ ID NO: 1407046 - protein, 9 aa, Homo Sapiens
NEDQPQPPY

SEQ ID NO: 1407047 - protein, 9 aa, Homo Sapiens
RRETGLFLP

SEQ ID NO: 1407048 - protein, 9 aa, Homo Sapiens
CRPWLEQML

SEQ ID NO: 1407049 - protein, 9 aa, Homo Sapiens
ALYVTLQAA

SEQ ID NO: 1407050 - protein, 9 aa, Homo Sapiens
TIVGNILLI

SEQ ID NO: 1407051 - protein, 9 aa, Homo Sapiens
SGQPSLHHQ

SEQ ID NO: 1407052 - protein, 9 aa, Homo Sapiens
SCIEGVDFE

SEQ ID NO: 1407053 - protein, 9 aa, Homo Sapiens
IQKSDFSNN

SEQ ID NO: 1407054 - protein, 9 aa, Homo Sapiens
ESPELHQKS

SEQ ID NO: 1407055 - protein, 9 aa, Homo Sapiens
PSQVWTAAT

SEQ ID NO: 1407056 - protein, 9 aa, Homo Sapiens
PVHNLLPVL

SEQ ID NO: 1407057 - protein, 9 aa, Homo Sapiens
KGGEQVCAL

SEQ ID NO: 1407058 - protein, 9 aa, Homo Sapiens
QEEKMETEQ

SEQ ID NO: 1407059 - protein, 9 aa, Homo Sapiens
HNVDHTSVL

SEQ ID NO: 1407060 - protein, 9 aa, Homo Sapiens
LKALKISMP

SEQ ID NO: 1407061 - protein, 9 aa, Homo Sapiens
LRPEPPKIR

SEQ ID NO: 1407062 - protein, 9 aa, Homo Sapiens
EVGPKTYIW

SEQ ID NO: 1407063 - protein, 9 aa, Homo Sapiens
GSEAGSKGS

SEQ ID NO: 1407064 - protein, 9 aa, Homo Sapiens
TLSQPPPQA

SEQ ID NO: 1407065 - protein, 9 aa, Homo Sapiens
HASEDIHKT

SEQ ID NO: 1407066 - protein, 9 aa, Homo Sapiens
SVPFWKESI

SEQ ID NO: 1407067 - protein, 9 aa, Homo Sapiens
FPTQARAAC

SEQ ID NO: 1407068 - protein, 9 aa, Homo Sapiens
IWQDNERVL

SEQ ID NO: 1407069 - protein, 9 aa, Homo Sapiens
DLQAVGVAD

SEQ ID NO: 1407070 - protein, 9 aa, Homo Sapiens
WADPQTQEL

SEQ ID NO: 1407071 - protein, 9 aa, Homo Sapiens
WNTSTPACS

SEQ ID NO: 1407072 - protein, 9 aa, Homo Sapiens
SLQEKSQGA

SEQ ID NO: 1407073 - protein, 9 aa, Homo Sapiens
YGVITPMMN

SEQ ID NO: 1407074 - protein, 9 aa, Homo Sapiens
AGGSANTVR

SEQ ID NO: 1407075 - protein, 9 aa, Homo Sapiens
GLVLPTCLL

SEQ ID NO: 1407076 - protein, 9 aa, Homo Sapiens
IGDFLDSVN

SEQ ID NO: 1407077 - protein, 9 aa, Homo Sapiens
EARKKPAAS

SEQ ID NO: 1407078 - protein, 9 aa, Homo Sapiens
ENFSLKLCI

SEQ ID NO: 1407079 - protein, 9 aa, Homo Sapiens
RRWEKDSSH

SEQ ID NO: 1407080 - protein, 9 aa, Homo Sapiens
QPEMPTSYR

SEQ ID NO: 1407081 - protein, 9 aa, Homo Sapiens
TTPKREDAM

SEQ ID NO: 1407082 - protein, 9 aa, Homo Sapiens
LPVEGTSPP

SEQ ID NO: 1407083 - protein, 9 aa, Homo Sapiens
ENWKDKDPT

SEQ ID NO: 1407084 - protein, 9 aa, Homo Sapiens
WLEQMLHSC

SEQ ID NO: 1407085 - protein, 9 aa, Homo Sapiens
GSPVLKSCL

SEQ ID NO: 1407086 - protein, 9 aa, Homo Sapiens
NEAHVSTNL

SEQ ID NO: 1407087 - protein, 9 aa, Homo Sapiens
MFYGVITPM

SEQ ID NO: 1407088 - protein, 9 aa, Homo Sapiens
KIAFKGIAQ

SEQ ID NO: 1407089 - protein, 9 aa, Homo Sapiens
RWFCRMWFM

SEQ ID NO: 1407090 - protein, 9 aa, Homo Sapiens
PGSSETLLE

SEQ ID NO: 1407091 - protein, 9 aa, Homo Sapiens
LLLALPITV

SEQ ID NO: 1407092 - protein, 9 aa, Homo Sapiens
GQPCSRQRQ

SEQ ID NO: 1407093 - protein, 9 aa, Homo Sapiens
LTHPLLVSL

SEQ ID NO: 1407094 - protein, 9 aa, Homo Sapiens
FKKHLQDVD

SEQ ID NO: 1407095 - protein, 9 aa, Homo Sapiens
VTITGQHMT

SEQ ID NO: 1407096 - protein, 9 aa, Homo Sapiens
SNQPVTPKA

SEQ ID NO: 1407097 - protein, 9 aa, Homo Sapiens
ILTGATSQH

SEQ ID NO: 1407098 - protein, 9 aa, Homo Sapiens
WMAAMFGGH

SEQ ID NO: 1407099 - protein, 9 aa, Homo Sapiens
AKELTHPLL

SEQ ID NO: 1407100 - protein, 9 aa, Homo Sapiens
AGPVQSCSQ

SEQ ID NO: 1407101 - protein, 9 aa, Homo Sapiens
APEFRCLGL

SEQ ID NO: 1407102 - protein, 9 aa, Homo Sapiens
HQTHLASKE

SEQ ID NO: 1407103 - protein, 9 aa, Homo Sapiens
NTNNYHNLY

SEQ ID NO: 1407104 - protein, 9 aa, Homo Sapiens
RYYDITVLC

SEQ ID NO: 1407105 - protein, 9 aa, Homo Sapiens
ECITLENSF

SEQ ID NO: 1407106 - protein, 9 aa, Homo Sapiens
RNFQKNRIL

SEQ ID NO: 1407107 - protein, 9 aa, Homo Sapiens
YCDPDWSSK

SEQ ID NO: 1407108 - protein, 9 aa, Homo Sapiens
KIRVRNGNR

SEQ ID NO: 1407109 - protein, 9 aa, Homo Sapiens
NDSARRKRI

SEQ ID NO: 1407110 - protein, 9 aa, Homo Sapiens
MRPVDMSKY

SEQ ID NO: 1407111 - protein, 9 aa, Homo Sapiens
CDKSSKRDT

SEQ ID NO: 1407112 - protein, 9 aa, Homo Sapiens
PTKTKKARF

SEQ ID NO: 1407113 - protein, 9 aa, Homo Sapiens
LPVLMVDED

SEQ ID NO: 1407114 - protein, 9 aa, Homo Sapiens
VVEASSSEC

SEQ ID NO: 1407115 - protein, 9 aa, Homo Sapiens
EFGHVIGFW

SEQ ID NO: 1407116 - protein, 9 aa, Homo Sapiens
PQIFTKSPQ

SEQ ID NO: 1407117 - protein, 9 aa, Homo Sapiens
RSKEIDEKE

SEQ ID NO: 1407118 - protein, 9 aa, Homo Sapiens
VGGGAGVLP

SEQ ID NO: 1407119 - protein, 9 aa, Homo Sapiens
MCEDFSNSV

SEQ ID NO: 1407120 - protein, 9 aa, Homo Sapiens
HRCRFCSQL

SEQ ID NO: 1407121 - protein, 9 aa, Homo Sapiens
LPGLTHPAH

SEQ ID NO: 1407122 - protein, 9 aa, Homo Sapiens
LMVDEDVTG

SEQ ID NO: 1407123 - protein, 9 aa, Homo Sapiens
LTWSPLLQD

SEQ ID NO: 1407124 - protein, 9 aa, Homo Sapiens
PFLNSQVGC

SEQ ID NO: 1407125 - protein, 9 aa, Homo Sapiens
GALEEYVRS

SEQ ID NO: 1407126 - protein, 9 aa, Homo Sapiens
HHWPVFVEV

SEQ ID NO: 1407127 - protein, 9 aa, Homo Sapiens
YQNSSIQIH

SEQ ID NO: 1407128 - protein, 9 aa, Homo Sapiens
RNMAKLGKV

SEQ ID NO: 1407129 - protein, 9 aa, Homo Sapiens
VEEGMYLLI

SEQ ID NO: 1407130 - protein, 9 aa, Homo Sapiens
KRGWMLNQF

SEQ ID NO: 1407131 - protein, 9 aa, Homo Sapiens
PVSNQPVTP

SEQ ID NO: 1407132 - protein, 9 aa, Homo Sapiens
KRYIFTNTF

SEQ ID NO: 1407133 - protein, 9 aa, Homo Sapiens
FCESCNTLT

SEQ ID NO: 1407134 - protein, 9 aa, Homo Sapiens
WFRSNPTKT

SEQ ID NO: 1407135 - protein, 9 aa, Homo Sapiens
TASVTLNVT

SEQ ID NO: 1407136 - protein, 9 aa, Homo Sapiens
SSKKYAKAV

SEQ ID NO: 1407137 - protein, 9 aa, Homo Sapiens
EAQLMTKNP

SEQ ID NO: 1407138 - protein, 9 aa, Homo Sapiens
SEMAHIQQN

SEQ ID NO: 1407139 - protein, 9 aa, Homo Sapiens
LVSGLCPLM

SEQ ID NO: 1407140 - protein, 9 aa, Homo Sapiens
PRPPPLVRC

SEQ ID NO: 1407141 - protein, 9 aa, Homo Sapiens
VADLGRLEG

SEQ ID NO: 1407142 - protein, 9 aa, Homo Sapiens
MPSSQECLQ

SEQ ID NO: 1407143 - protein, 9 aa, Homo Sapiens
KIEDADPYH

SEQ ID NO: 1407144 - protein, 9 aa, Homo Sapiens
ITAPPVSNQ

SEQ ID NO: 1407145 - protein, 9 aa, Homo Sapiens
KNRHTIEVN

SEQ ID NO: 1407146 - protein, 9 aa, Homo Sapiens
DADPYHAYV

SEQ ID NO: 1407147 - protein, 9 aa, Homo Sapiens
YIKVVHVTV

SEQ ID NO: 1407148 - protein, 9 aa, Homo Sapiens
SVAWGPSWR

SEQ ID NO: 1407149 - protein, 9 aa, Homo Sapiens
KQSGHTQTD

SEQ ID NO: 1407150 - protein, 9 aa, Homo Sapiens
YETTVVRHD

SEQ ID NO: 1407151 - protein, 9 aa, Homo Sapiens
VLELAGNTS

SEQ ID NO: 1407152 - protein, 9 aa, Homo Sapiens
WKKLFSQLV

SEQ ID NO: 1407153 - protein, 9 aa, Homo Sapiens
KQGFHMKQG

SEQ ID NO: 1407154 - protein, 9 aa, Homo Sapiens
ALPITVLAV

SEQ ID NO: 1407155 - protein, 9 aa, Homo Sapiens
VEGVEGPHC

SEQ ID NO: 1407156 - protein, 9 aa, Homo Sapiens
CAKRKLYQF

SEQ ID NO: 1407157 - protein, 9 aa, Homo Sapiens
SSLYIHFKK

SEQ ID NO: 1407158 - protein, 9 aa, Homo Sapiens
PPQAPSQVW

SEQ ID NO: 1407159 - protein, 9 aa, Homo Sapiens
APPGRWCFP

SEQ ID NO: 1407160 - protein, 9 aa, Homo Sapiens
TVVRHDLML

SEQ ID NO: 1407161 - protein, 9 aa, Homo Sapiens
KKLFSQLVE

SEQ ID NO: 1407162 - protein, 9 aa, Homo Sapiens
IVCSCIEGV

SEQ ID NO: 1407163 - protein, 9 aa, Homo Sapiens
QTTICRFET

SEQ ID NO: 1407164 - protein, 9 aa, Homo Sapiens
DLHHGLGLL

SEQ ID NO: 1407165 - protein, 9 aa, Homo Sapiens
PESSKKYAK

SEQ ID NO: 1407166 - protein, 9 aa, Homo Sapiens
NDKQGFHMK

SEQ ID NO: 1407167 - protein, 9 aa, Homo Sapiens
IRLNGSAAG

SEQ ID NO: 1407168 - protein, 9 aa, Homo Sapiens
SLPGPGRHH

SEQ ID NO: 1407169 - protein, 9 aa, Homo Sapiens
LAKELTHPL

SEQ ID NO: 1407170 - protein, 9 aa, Homo Sapiens
TYLHKLREN

SEQ ID NO: 1407171 - protein, 9 aa, Homo Sapiens
LLCPALHLV

SEQ ID NO: 1407172 - protein, 9 aa, Homo Sapiens
GIICVADQC

SEQ ID NO: 1407173 - protein, 9 aa, Homo Sapiens
IFSVVNAGS

SEQ ID NO: 1407174 - protein, 9 aa, Homo Sapiens
EALTLPQFI

SEQ ID NO: 1407175 - protein, 9 aa, Homo Sapiens
KRRKVYGIE

SEQ ID NO: 1407176 - protein, 9 aa, Homo Sapiens
PMHKTINTD

SEQ ID NO: 1407177 - protein, 9 aa, Homo Sapiens
PAPEIRLSS

SEQ ID NO: 1407178 - protein, 9 aa, Homo Sapiens
PLLVSLLLK

SEQ ID NO: 1407179 - protein, 9 aa, Homo Sapiens
QIEHYSMDV

SEQ ID NO: 1407180 - protein, 9 aa, Homo Sapiens
PFLESKQNC

SEQ ID NO: 1407181 - protein, 9 aa, Homo Sapiens
RVLRLITSQ

SEQ ID NO: 1407182 - protein, 9 aa, Homo Sapiens
VILTHNGTS

SEQ ID NO: 1407183 - protein, 9 aa, Homo Sapiens
PKNRHTIEV

SEQ ID NO: 1407184 - protein, 9 aa, Homo Sapiens
DRKRKQEEK

SEQ ID NO: 1407185 - protein, 9 aa, Homo Sapiens
KQLYNELNL

SEQ ID NO: 1407186 - protein, 9 aa, Homo Sapiens
GRWKKLFSQ

SEQ ID NO: 1407187 - protein, 9 aa, Homo Sapiens
THPLLVSLL

SEQ ID NO: 1407188 - protein, 9 aa, Homo Sapiens
EGRWKKLFS

SEQ ID NO: 1407189 - protein, 9 aa, Homo Sapiens
CPGHASREN

SEQ ID NO: 1407190 - protein, 9 aa, Homo Sapiens
VEILQSTLS

SEQ ID NO: 1407191 - protein, 9 aa, Homo Sapiens
YWNEDQPQP

SEQ ID NO: 1407192 - protein, 9 aa, Homo Sapiens
EFLMGGMSR

SEQ ID NO: 1407193 - protein, 9 aa, Homo Sapiens
PCCDPSGLG

SEQ ID NO: 1407194 - protein, 9 aa, Homo Sapiens
EPPKIRMYS

SEQ ID NO: 1407195 - protein, 9 aa, Homo Sapiens
EGEIISKKT

SEQ ID NO: 1407196 - protein, 9 aa, Homo Sapiens
PSLPGPCAS

SEQ ID NO: 1407197 - protein, 9 aa, Homo Sapiens
QLMTKNPLA

SEQ ID NO: 1407198 - protein, 9 aa, Homo Sapiens
WEEPGGCTQ

SEQ ID NO: 1407199 - protein, 9 aa, Homo Sapiens
RHDLMLVGP

SEQ ID NO: 1407200 - protein, 9 aa, Homo Sapiens
SKGGEQVCA

SEQ ID NO: 1407201 - protein, 9 aa, Homo Sapiens
SIHDTERLD

SEQ ID NO: 1407202 - protein, 9 aa, Homo Sapiens
SSEHTQMVA

SEQ ID NO: 1407203 - protein, 9 aa, Homo Sapiens
KDPTEWRFQ

SEQ ID NO: 1407204 - protein, 9 aa, Homo Sapiens
HPGVTMHRE

SEQ ID NO: 1407205 - protein, 9 aa, Homo Sapiens
GYICLKTYD

SEQ ID NO: 1407206 - protein, 9 aa, Homo Sapiens
IKVHDIRLN

SEQ ID NO: 1407207 - protein, 9 aa, Homo Sapiens
VESGGPHLL

SEQ ID NO: 1407208 - protein, 9 aa, Homo Sapiens
TICRFETLQ

SEQ ID NO: 1407209 - protein, 9 aa, Homo Sapiens
DPELRRPRS

SEQ ID NO: 1407210 - protein, 9 aa, Homo Sapiens
GKCPLNPHI

SEQ ID NO: 1407211 - protein, 9 aa, Homo Sapiens
DTEGGWHLW

SEQ ID NO: 1407212 - protein, 9 aa, Homo Sapiens
AFRKGKSSL

SEQ ID NO: 1407213 - protein, 9 aa, Homo Sapiens
IIPPFEDDT

SEQ ID NO: 1407214 - protein, 9 aa, Homo Sapiens
DYFHHWPVF

SEQ ID NO: 1407215 - protein, 9 aa, Homo Sapiens
CLGLAAKLM

SEQ ID NO: 1407216 - protein, 9 aa, Homo Sapiens
VITPMMNPL

SEQ ID NO: 1407217 - protein, 9 aa, Homo Sapiens
PGPCASLLS

SEQ ID NO: 1407218 - protein, 9 aa, Homo Sapiens
PQPSLPGPC

SEQ ID NO: 1407219 - protein, 9 aa, Homo Sapiens
GTIVNVPKK

SEQ ID NO: 1407220 - protein, 9 aa, Homo Sapiens
PLLASEDRR

SEQ ID NO: 1407221 - protein, 9 aa, Homo Sapiens
LGIISVEIL

SEQ ID NO: 1407222 - protein, 9 aa, Homo Sapiens
LIILPGNSL

SEQ ID NO: 1407223 - protein, 9 aa, Homo Sapiens
ESKQNCSHF

SEQ ID NO: 1407224 - protein, 9 aa, Homo Sapiens
IEGVDFEIT

SEQ ID NO: 1407225 - protein, 9 aa, Homo Sapiens
LRCPAVPAA

SEQ ID NO: 1407226 - protein, 9 aa, Homo Sapiens
ECYRGNGKN

SEQ ID NO: 1407227 - protein, 9 aa, Homo Sapiens
PGGSEAGSK

SEQ ID NO: 1407228 - protein, 9 aa, Homo Sapiens
GTWADPQTQ

SEQ ID NO: 1407229 - protein, 9 aa, Homo Sapiens
TWADPQTQE

SEQ ID NO: 1407230 - protein, 9 aa, Homo Sapiens
MKSEMAHIQ

SEQ ID NO: 1407231 - protein, 9 aa, Homo Sapiens
QVVEASSSE

SEQ ID NO: 1407232 - protein, 9 aa, Homo Sapiens
CDMSHGQEC

SEQ ID NO: 1407233 - protein, 9 aa, Homo Sapiens
QCDPGYEFQ

SEQ ID NO: 1407234 - protein, 9 aa, Homo Sapiens
LPAQKTARC

SEQ ID NO: 1407235 - protein, 9 aa, Homo Sapiens
TGLFLPSAA

SEQ ID NO: 1407236 - protein, 9 aa, Homo Sapiens
EAGPVQSCS

SEQ ID NO: 1407237 - protein, 9 aa, Homo Sapiens
PASWAPQMR

SEQ ID NO: 1407238 - protein, 9 aa, Homo Sapiens
GRACFCALL

SEQ ID NO: 1407239 - protein, 9 aa, Homo Sapiens
RRKVYGIEH

SEQ ID NO: 1407240 - protein, 9 aa, Homo Sapiens
LDSVNRRIM

SEQ ID NO: 1407241 - protein, 9 aa, Homo Sapiens
VHNLLPVLM

SEQ ID NO: 1407242 - protein, 9 aa, Homo Sapiens
LPDRQEHQK

SEQ ID NO: 1407243 - protein, 9 aa, Homo Sapiens
GEAAEKIYI

SEQ ID NO: 1407244 - protein, 9 aa, Homo Sapiens
YICAKCGKA

SEQ ID NO: 1407245 - protein, 9 aa, Homo Sapiens
YPLTAISVE

SEQ ID NO: 1407246 - protein, 9 aa, Homo Sapiens
AKNTRAQSG

SEQ ID NO: 1407247 - protein, 9 aa, Homo Sapiens
PGLTHPAHQ

SEQ ID NO: 1407248 - protein, 9 aa, Homo Sapiens
IERNFPPYN

SEQ ID NO: 1407249 - protein, 9 aa, Homo Sapiens
NITTPKRED

SEQ ID NO: 1407250 - protein, 9 aa, Homo Sapiens
VLRLITSQV

SEQ ID NO: 1407251 - protein, 9 aa, Homo Sapiens
LAAACSVTY

SEQ ID NO: 1407252 - protein, 9 aa, Homo Sapiens
LHHGLGLLG

SEQ ID NO: 1407253 - protein, 9 aa, Homo Sapiens
TGPAAPLAP

SEQ ID NO: 1407254 - protein, 9 aa, Homo Sapiens
QVEEGPSTS

SEQ ID NO: 1407255 - protein, 9 aa, Homo Sapiens
HGTLPSRAP

SEQ ID NO: 1407256 - protein, 9 aa, Homo Sapiens
VTGAVVLQV

SEQ ID NO: 1407257 - protein, 9 aa, Homo Sapiens
CLLASWQPG

SEQ ID NO: 1407258 - protein, 9 aa, Homo Sapiens
RLMGRTLIV

SEQ ID NO: 1407259 - protein, 9 aa, Homo Sapiens
EEKMETEQQ

SEQ ID NO: 1407260 - protein, 9 aa, Homo Sapiens
NLLVSASRD

SEQ ID NO: 1407261 - protein, 9 aa, Homo Sapiens
ALQDLGLRM

SEQ ID NO: 1407262 - protein, 9 aa, Homo Sapiens
VVEKLRRQM

SEQ ID NO: 1407263 - protein, 9 aa, Homo Sapiens
TPQPHLCRE

SEQ ID NO: 1407264 - protein, 9 aa, Homo Sapiens
CSECGWIFK

SEQ ID NO: 1407265 - protein, 9 aa, Homo Sapiens
HNLDNYLFF

SEQ ID NO: 1407266 - protein, 9 aa, Homo Sapiens
QRDVILTHN

SEQ ID NO: 1407267 - protein, 9 aa, Homo Sapiens
PSTSRSCMT

SEQ ID NO: 1407268 - protein, 9 aa, Homo Sapiens
KTYIWQDNE

SEQ ID NO: 1407269 - protein, 9 aa, Homo Sapiens
APLAPPALV

SEQ ID NO: 1407270 - protein, 9 aa, Homo Sapiens
RNFPPYNGF

SEQ ID NO: 1407271 - protein, 9 aa, Homo Sapiens
VREIMLEEP

SEQ ID NO: 1407272 - protein, 9 aa, Homo Sapiens
AGVLPDRQE

SEQ ID NO: 1407273 - protein, 9 aa, Homo Sapiens
RLMITHHVV

SEQ ID NO: 1407274 - protein, 9 aa, Homo Sapiens
KIKIVGLRL

SEQ ID NO: 1407275 - protein, 9 aa, Homo Sapiens
GSKGSGEGE

SEQ ID NO: 1407276 - protein, 9 aa, Homo Sapiens
PVLMVDEDV

SEQ ID NO: 1407277 - protein, 9 aa, Homo Sapiens
QSALYVTLQ

SEQ ID NO: 1407278 - protein, 9 aa, Homo Sapiens
LSLYRNMAK

SEQ ID NO: 1407279 - protein, 9 aa, Homo Sapiens
KSDFSNNWN

SEQ ID NO: 1407280 - protein, 9 aa, Homo Sapiens
KTEIDKLAT

SEQ ID NO: 1407281 - protein, 9 aa, Homo Sapiens
GATSQHQPW

SEQ ID NO: 1407282 - protein, 9 aa, Homo Sapiens
YKMFHHTAV

SEQ ID NO: 1407283 - protein, 9 aa, Homo Sapiens
YLCWECGKL

SEQ ID NO: 1407284 - protein, 9 aa, Homo Sapiens
TSKDLKVKR

SEQ ID NO: 1407285 - protein, 9 aa, Homo Sapiens
CRNPDRELQ

SEQ ID NO: 1407286 - protein, 9 aa, Homo Sapiens
NIDLSDKTL

SEQ ID NO: 1407287 - protein, 9 aa, Homo Sapiens
FPVTVIILS

SEQ ID NO: 1407288 - protein, 9 aa, Homo Sapiens
KKTESHHRA

SEQ ID NO: 1407289 - protein, 9 aa, Homo Sapiens
VRKQTLNFH

SEQ ID NO: 1407290 - protein, 9 aa, Homo Sapiens
LSSCCLLSP

SEQ ID NO: 1407291 - protein, 9 aa, Homo Sapiens
LQVVEASSS

SEQ ID NO: 1407292 - protein, 9 aa, Homo Sapiens
TMCEDFSNS

SEQ ID NO: 1407293 - protein, 9 aa, Homo Sapiens
CAKCGKAFT

SEQ ID NO: 1407294 - protein, 9 aa, Homo Sapiens
RQRQILHLG

SEQ ID NO: 1407295 - protein, 9 aa, Homo Sapiens
VNLVPLFCE

SEQ ID NO: 1407296 - protein, 9 aa, Homo Sapiens
PSIHPIYEP

SEQ ID NO: 1407297 - protein, 9 aa, Homo Sapiens
LTGTWADPQ

SEQ ID NO: 1407298 - protein, 9 aa, Homo Sapiens
QECLQSRVT

SEQ ID NO: 1407299 - protein, 9 aa, Homo Sapiens
VNYFILESQ

SEQ ID NO: 1407300 - protein, 9 aa, Homo Sapiens
SMTISRGCC

SEQ ID NO: 1407301 - protein, 9 aa, Homo Sapiens
STSRSCMTS

SEQ ID NO: 1407302 - protein, 9 aa, Homo Sapiens
ICRFETLQL

SEQ ID NO: 1407303 - protein, 9 aa, Homo Sapiens
TKTLEGPSF

SEQ ID NO: 1407304 - protein, 9 aa, Homo Sapiens
AHVSTNLKT

SEQ ID NO: 1407305 - protein, 9 aa, Homo Sapiens
TPLSISRPT

SEQ ID NO: 1407306 - protein, 9 aa, Homo Sapiens
DSLGAFSHV

SEQ ID NO: 1407307 - protein, 9 aa, Homo Sapiens
RLCTVWDPI

SEQ ID NO: 1407308 - protein, 9 aa, Homo Sapiens
SVGNTTASV

SEQ ID NO: 1407309 - protein, 9 aa, Homo Sapiens
NMINTEECI

SEQ ID NO: 1407310 - protein, 9 aa, Homo Sapiens
YTVLAVAAT

SEQ ID NO: 1407311 - protein, 9 aa, Homo Sapiens
LQSTLSFCQ

SEQ ID NO: 1407312 - protein, 9 aa, Homo Sapiens
NNPDVSYER

SEQ ID NO: 1407313 - protein, 9 aa, Homo Sapiens
ELPSQSRCS

SEQ ID NO: 1407314 - protein, 9 aa, Homo Sapiens
RACAPKERP

SEQ ID NO: 1407315 - protein, 9 aa, Homo Sapiens
CSIAFPLLC

SEQ ID NO: 1407316 - protein, 9 aa, Homo Sapiens
QKMKKAHFL

SEQ ID NO: 1407317 - protein, 9 aa, Homo Sapiens
QSCCLPGLT

SEQ ID NO: 1407318 - protein, 9 aa, Homo Sapiens
LIVEVSVET

SEQ ID NO: 1407319 - protein, 9 aa, Homo Sapiens
CECYESYTL

SEQ ID NO: 1407320 - protein, 9 aa, Homo Sapiens
IDEKERRIK

SEQ ID NO: 1407321 - protein, 9 aa, Homo Sapiens
RHICGAVHG

SEQ ID NO: 1407322 - protein, 9 aa, Homo Sapiens
KTESHHRAK

SEQ ID NO: 1407323 - protein, 9 aa, Homo Sapiens
ILQRSSLMR

SEQ ID NO: 1407324 - protein, 9 aa, Homo Sapiens
TRFWTWINR

SEQ ID NO: 1407325 - protein, 9 aa, Homo Sapiens
LQAVGVADL

SEQ ID NO: 1407326 - protein, 9 aa, Homo Sapiens
ASVTLNVTA

SEQ ID NO: 1407327 - protein, 9 aa, Homo Sapiens
EAGSKGSGE

SEQ ID NO: 1407328 - protein, 9 aa, Homo Sapiens
GMIFSRVLR

SEQ ID NO: 1407329 - protein, 9 aa, Homo Sapiens
TDHQTPQPH

SEQ ID NO: 1407330 - protein, 9 aa, Homo Sapiens
SQPPPQAPS

SEQ ID NO: 1407331 - protein, 9 aa, Homo Sapiens
DRELQPWCF

SEQ ID NO: 1407332 - protein, 9 aa, Homo Sapiens
RKIHQLELQ

SEQ ID NO: 1407333 - protein, 9 aa, Homo Sapiens
ISFFVMFLM

SEQ ID NO: 1407334 - protein, 9 aa, Homo Sapiens
GYTVLAVAA

SEQ ID NO: 1407335 - protein, 9 aa, Homo Sapiens
NEVNPFENK

SEQ ID NO: 1407336 - protein, 9 aa, Homo Sapiens
NEASEENNG

SEQ ID NO: 1407337 - protein, 9 aa, Homo Sapiens
HDIRLNGSA

SEQ ID NO: 1407338 - protein, 9 aa, Homo Sapiens
IFSRVLRRM

SEQ ID NO: 1407339 - protein, 9 aa, Homo Sapiens
VLHQNLDPT

SEQ ID NO: 1407340 - protein, 9 aa, Homo Sapiens
RAGYLVYFT

SEQ ID NO: 1407341 - protein, 9 aa, Homo Sapiens
SFQEEIVQV

SEQ ID NO: 1407342 - protein, 9 aa, Homo Sapiens
PTSRARQSC

SEQ ID NO: 1407343 - protein, 9 aa, Homo Sapiens
PGWEEPGGC

SEQ ID NO: 1407344 - protein, 9 aa, Homo Sapiens
YCFSIVADH

SEQ ID NO: 1407345 - protein, 9 aa, Homo Sapiens
LMGRTLIVE

SEQ ID NO: 1407346 - protein, 9 aa, Homo Sapiens
NAHNVDHTS

SEQ ID NO: 1407347 - protein, 9 aa, Homo Sapiens
GNVESGGPH

SEQ ID NO: 1407348 - protein, 9 aa, Homo Sapiens
IKVVHVTVF

SEQ ID NO: 1407349 - protein, 9 aa, Homo Sapiens
EKTQFLMAM

SEQ ID NO: 1407350 - protein, 9 aa, Homo Sapiens
MFHHTAVLK

SEQ ID NO: 1407351 - protein, 9 aa, Homo Sapiens
GQSTGPGWE

SEQ ID NO: 1407352 - protein, 9 aa, Homo Sapiens
RCSIAFPLL

SEQ ID NO: 1407353 - protein, 9 aa, Homo Sapiens
YVEESSWDD

SEQ ID NO: 1407354 - protein, 9 aa, Homo Sapiens
TEVVRRCRH

SEQ ID NO: 1407355 - protein, 9 aa, Homo Sapiens
AVAATHCHN

SEQ ID NO: 1407356 - protein, 9 aa, Homo Sapiens
KAVTRAKQI

SEQ ID NO: 1407357 - protein, 9 aa, Homo Sapiens
TKRGWMLNQ

SEQ ID NO: 1407358 - protein, 9 aa, Homo Sapiens
HSCRIQKSD

SEQ ID NO: 1407359 - protein, 9 aa, Homo Sapiens
WNSSTQWGS

SEQ ID NO: 1407360 - protein, 9 aa, Homo Sapiens
LKTWFRSNP

SEQ ID NO: 1407361 - protein, 9 aa, Homo Sapiens
VSPAGIICV

SEQ ID NO: 1407362 - protein, 9 aa, Homo Sapiens
TLPSRAPAS

SEQ ID NO: 1407363 - protein, 9 aa, Homo Sapiens
TSRARQSCC

SEQ ID NO: 1407364 - protein, 9 aa, Homo Sapiens
NDGSPVLKS

SEQ ID NO: 1407365 - protein, 9 aa, Homo Sapiens
DVTGAVVLQ

SEQ ID NO: 1407366 - protein, 9 aa, Homo Sapiens
LITTGIRKV

SEQ ID NO: 1407367 - protein, 9 aa, Homo Sapiens
GDEEEEDDY

SEQ ID NO: 1407368 - protein, 9 aa, Homo Sapiens
PLTIFANWR

SEQ ID NO: 1407369 - protein, 9 aa, Homo Sapiens
RTLIVEVSV

SEQ ID NO: 1407370 - protein, 9 aa, Homo Sapiens
QNCSHFPTP

SEQ ID NO: 1407371 - protein, 9 aa, Homo Sapiens
KDKDPTEWR

SEQ ID NO: 1407372 - protein, 9 aa, Homo Sapiens
LLQPASLPL

SEQ ID NO: 1407373 - protein, 9 aa, Homo Sapiens
YGALPPPCC

SEQ ID NO: 1407374 - protein, 9 aa, Homo Sapiens
APSQVWTAA

SEQ ID NO: 1407375 - protein, 9 aa, Homo Sapiens
FRKGKSSLL

SEQ ID NO: 1407376 - protein, 9 aa, Homo Sapiens
NSYCRETLQ

SEQ ID NO: 1407377 - protein, 9 aa, Homo Sapiens
PRGMPYHQS

SEQ ID NO: 1407378 - protein, 9 aa, Homo Sapiens
SHGQECYRG

SEQ ID NO: 1407379 - protein, 9 aa, Homo Sapiens
DLEWQNQML

SEQ ID NO: 1407380 - protein, 9 aa, Homo Sapiens
ENNGQQSQE

SEQ ID NO: 1407381 - protein, 9 aa, Homo Sapiens
EVVRRCRHH

SEQ ID NO: 1407382 - protein, 9 aa, Homo Sapiens
VSKISFFVM

SEQ ID NO: 1407383 - protein, 9 aa, Homo Sapiens
EMPTSYRCS

SEQ ID NO: 1407384 - protein, 9 aa, Homo Sapiens
VSNQPVTPK

SEQ ID NO: 1407385 - protein, 9 aa, Homo Sapiens
PHGTLPSRA

SEQ ID NO: 1407386 - protein, 9 aa, Homo Sapiens
SQPEMPTSY

SEQ ID NO: 1407387 - protein, 9 aa, Homo Sapiens
PESERNNPD

SEQ ID NO: 1407388 - protein, 9 aa, Homo Sapiens
TCNQYGKSF

SEQ ID NO: 1407389 - protein, 9 aa, Homo Sapiens
TNGITVFGK

SEQ ID NO: 1407390 - protein, 9 aa, Homo Sapiens
WDDDEDDGD

SEQ ID NO: 1407391 - protein, 9 aa, Homo Sapiens
NTSSLIGIN

SEQ ID NO: 1407392 - protein, 9 aa, Homo Sapiens
GLTHPAHQP

SEQ ID NO: 1407393 - protein, 9 aa, Homo Sapiens
CNQYGKSFV

SEQ ID NO: 1407394 - protein, 9 aa, Homo Sapiens
RLLRVLQNP

SEQ ID NO: 1407395 - protein, 9 aa, Homo Sapiens
LALPITVLA

SEQ ID NO: 1407396 - protein, 9 aa, Homo Sapiens
TVIILSYSH

SEQ ID NO: 1407397 - protein, 9 aa, Homo Sapiens
ALTLPQFIL

SEQ ID NO: 1407398 - protein, 9 aa, Homo Sapiens
TKRKNMRPV

SEQ ID NO: 1407399 - protein, 9 aa, Homo Sapiens
MVEIGDENA

SEQ ID NO: 1407400 - protein, 9 aa, Homo Sapiens
QYKKDTATW

SEQ ID NO: 1407401 - protein, 9 aa, Homo Sapiens
TLNFHFWTR

SEQ ID NO: 1407402 - protein, 9 aa, Homo Sapiens
YTLTIVGNI

SEQ ID NO: 1407403 - protein, 9 aa, Homo Sapiens
SFSKWCRPW

SEQ ID NO: 1407404 - protein, 9 aa, Homo Sapiens
TPQPSLPGP

SEQ ID NO: 1407405 - protein, 9 aa, Homo Sapiens
LLSVMVYDR

SEQ ID NO: 1407406 - protein, 9 aa, Homo Sapiens
KENWKDKDP

SEQ ID NO: 1407407 - protein, 9 aa, Homo Sapiens
GGGTPLSIS

SEQ ID NO: 1407408 - protein, 9 aa, Homo Sapiens
LASWQPGGC

SEQ ID NO: 1407409 - protein, 9 aa, Homo Sapiens
NPHIHLGTY

SEQ ID NO: 1407410 - protein, 9 aa, Homo Sapiens
TWSPLLQDG

SEQ ID NO: 1407411 - protein, 9 aa, Homo Sapiens
SRMAPPASW

SEQ ID NO: 1407412 - protein, 9 aa, Homo Sapiens
CIYFLEERM

SEQ ID NO: 1407413 - protein, 9 aa, Homo Sapiens
QMLHSCRIQ

SEQ ID NO: 1407414 - protein, 9 aa, Homo Sapiens
GVTMHREDL

SEQ ID NO: 1407415 - protein, 9 aa, Homo Sapiens
NTSTPACSP

SEQ ID NO: 1407416 - protein, 9 aa, Homo Sapiens
RVFDLEWQN

SEQ ID NO: 1407417 - protein, 9 aa, Homo Sapiens
EDLKTEIDK

SEQ ID NO: 1407418 - protein, 9 aa, Homo Sapiens
QDLGLRMVE

SEQ ID NO: 1407419 - protein, 9 aa, Homo Sapiens
LFCESCNTL

SEQ ID NO: 1407420 - protein, 9 aa, Homo Sapiens
VEAQLMTKN

SEQ ID NO: 1407421 - protein, 9 aa, Homo Sapiens
KIFQNHRIK

SEQ ID NO: 1407422 - protein, 9 aa, Homo Sapiens
KPQIFTKSP

SEQ ID NO: 1407423 - protein, 9 aa, Homo Sapiens
SKKYAKAVT

SEQ ID NO: 1407424 - protein, 9 aa, Homo Sapiens
AACGPCWNT

SEQ ID NO: 1407425 - protein, 9 aa, Homo Sapiens
SGHIKRPKN

SEQ ID NO: 1407426 - protein, 9 aa, Homo Sapiens
GPCWNTSTP

SEQ ID NO: 1407427 - protein, 9 aa, Homo Sapiens
EFVNLVPLF

SEQ ID NO: 1407428 - protein, 9 aa, Homo Sapiens
KIVGLRLLR

SEQ ID NO: 1407429 - protein, 9 aa, Homo Sapiens
QQGQKQLYN

SEQ ID NO: 1407430 - protein, 9 aa, Homo Sapiens
TTLLIGLAM

SEQ ID NO: 1407431 - protein, 9 aa, Homo Sapiens
NTGLYPLTA

SEQ ID NO: 1407432 - protein, 9 aa, Homo Sapiens
MSRTPPRRV

SEQ ID NO: 1407433 - protein, 9 aa, Homo Sapiens
NRLMGRTLI

SEQ ID NO: 1407434 - protein, 9 aa, Homo Sapiens
QKQLYNELN

SEQ ID NO: 1407435 - protein, 9 aa, Homo Sapiens
VTVIASTDP

SEQ ID NO: 1407436 - protein, 9 aa, Homo Sapiens
SETLLEVNE

SEQ ID NO: 1407437 - protein, 9 aa, Homo Sapiens
APPALVAPR

SEQ ID NO: 1407438 - protein, 9 aa, Homo Sapiens
HHTVRKQTL

SEQ ID NO: 1407439 - protein, 9 aa, Homo Sapiens
FLPSAAQKM

SEQ ID NO: 1407440 - protein, 9 aa, Homo Sapiens
GAGVLPDRQ

SEQ ID NO: 1407441 - protein, 9 aa, Homo Sapiens
HQSAPHILT

SEQ ID NO: 1407442 - protein, 9 aa, Homo Sapiens
PYSFKPFFL

SEQ ID NO: 1407443 - protein, 9 aa, Homo Sapiens
RQQWEARKK

SEQ ID NO: 1407444 - protein, 9 aa, Homo Sapiens
RPWLEQMLH

SEQ ID NO: 1407445 - protein, 9 aa, Homo Sapiens
QTHLASKES

SEQ ID NO: 1407446 - protein, 9 aa, Homo Sapiens
GMPGTACGM

SEQ ID NO: 1407447 - protein, 9 aa, Homo Sapiens
PHLCRELHP

SEQ ID NO: 1407448 - protein, 9 aa, Homo Sapiens
VLKPESGCL

SEQ ID NO: 1407449 - protein, 9 aa, Homo Sapiens
VERRWEKDS

SEQ ID NO: 1407450 - protein, 9 aa, Homo Sapiens
LASFQEEIV

SEQ ID NO: 1407451 - protein, 9 aa, Homo Sapiens
QPWPSTSRS

SEQ ID NO: 1407452 - protein, 9 aa, Homo Sapiens
TLTIVGNIL

SEQ ID NO: 1407453 - protein, 9 aa, Homo Sapiens
ERRWEKDSS

SEQ ID NO: 1407454 - protein, 9 aa, Homo Sapiens
ICGAVHGQQ

SEQ ID NO: 1407455 - protein, 9 aa, Homo Sapiens
TVVEKLRRQ

SEQ ID NO: 1407456 - protein, 9 aa, Homo Sapiens
CSPPAPTWM

SEQ ID NO: 1407457 - protein, 9 aa, Homo Sapiens
PPTVTSTIH

SEQ ID NO: 1407458 - protein, 9 aa, Homo Sapiens
LLQDGGSDI

SEQ ID NO: 1407459 - protein, 9 aa, Homo Sapiens
GLRRRPQPN

SEQ ID NO: 1407460 - protein, 9 aa, Homo Sapiens
MITHHVVIL

SEQ ID NO: 1407461 - protein, 9 aa, Homo Sapiens
KMKKAHFLK

SEQ ID NO: 1407462 - protein, 9 aa, Homo Sapiens
NLKFANSYR

SEQ ID NO: 1407463 - protein, 9 aa, Homo Sapiens
DMSHGQECY

SEQ ID NO: 1407464 - protein, 9 aa, Homo Sapiens
PLMLSWHQA

SEQ ID NO: 1407465 - protein, 9 aa, Homo Sapiens
RKVCLLSTR

SEQ ID NO: 1407466 - protein, 9 aa, Homo Sapiens
QQEELRTVV

SEQ ID NO: 1407467 - protein, 9 aa, Homo Sapiens
LRVLRLITS

SEQ ID NO: 1407468 - protein, 9 aa, Homo Sapiens
ASRENPHGT

SEQ ID NO: 1407469 - protein, 9 aa, Homo Sapiens
ITTPKREDA

SEQ ID NO: 1407470 - protein, 9 aa, Homo Sapiens
MPDLHLKAL

SEQ ID NO: 1407471 - protein, 9 aa, Homo Sapiens
PKIERNFPP

SEQ ID NO: 1407472 - protein, 9 aa, Homo Sapiens
MYQNSSIQI

SEQ ID NO: 1407473 - protein, 9 aa, Homo Sapiens
SSLMRQVFK

SEQ ID NO: 1407474 - protein, 9 aa, Homo Sapiens
PPPQAPSQV

SEQ ID NO: 1407475 - protein, 9 aa, Homo Sapiens
MIENSSWTM

SEQ ID NO: 1407476 - protein, 9 aa, Homo Sapiens
LRLPAKDWK

SEQ ID NO: 1407477 - protein, 9 aa, Homo Sapiens
IASTDPELR

SEQ ID NO: 1407478 - protein, 9 aa, Homo Sapiens
LPGPGRHHR

SEQ ID NO: 1407479 - protein, 9 aa, Homo Sapiens
NFEDFKNDK

SEQ ID NO: 1407480 - protein, 9 aa, Homo Sapiens
KMFHHTAVL

SEQ ID NO: 1407481 - protein, 9 aa, Homo Sapiens
VLASLKIPE

SEQ ID NO: 1407482 - protein, 9 aa, Homo Sapiens
FQNHRIKFE

SEQ ID NO: 1407483 - protein, 9 aa, Homo Sapiens
TASLAKELT

SEQ ID NO: 1407484 - protein, 9 aa, Homo Sapiens
CRMWFMNEK

SEQ ID NO: 1407485 - protein, 9 aa, Homo Sapiens
GLCPLMLSW

SEQ ID NO: 1407486 - protein, 9 aa, Homo Sapiens
CLPGLTHPA

SEQ ID NO: 1407487 - protein, 9 aa, Homo Sapiens
LNQFFLLEE

SEQ ID NO: 1407488 - protein, 9 aa, Homo Sapiens
MTISRGCCR

SEQ ID NO: 1407489 - protein, 9 aa, Homo Sapiens
EVPQLKQEF

SEQ ID NO: 1407490 - protein, 9 aa, Homo Sapiens
FCRAGYLVY

SEQ ID NO: 1407491 - protein, 9 aa, Homo Sapiens
GARFCRAGY

SEQ ID NO: 1407492 - protein, 9 aa, Homo Sapiens
TLLRCLSLE

SEQ ID NO: 1407493 - protein, 9 aa, Homo Sapiens
VFHVDVEVN

SEQ ID NO: 1407494 - protein, 9 aa, Homo Sapiens
TMATLYCDP

SEQ ID NO: 1407495 - protein, 9 aa, Homo Sapiens
GHHDPPPMD

SEQ ID NO: 1407496 - protein, 9 aa, Homo Sapiens
HGKRGSVDS

SEQ ID NO: 1407497 - protein, 9 aa, Homo Sapiens
SSLIGINTS

SEQ ID NO: 1407498 - protein, 9 aa, Homo Sapiens
SEAGSKGSG

SEQ ID NO: 1407499 - protein, 9 aa, Homo Sapiens
KATAEKFKV

SEQ ID NO: 1407500 - protein, 9 aa, Homo Sapiens
EGPHCDKCT

SEQ ID NO: 1407501 - protein, 9 aa, Homo Sapiens
SMFYGVITP

SEQ ID NO: 1407502 - protein, 9 aa, Homo Sapiens
EDADPYHAY

SEQ ID NO: 1407503 - protein, 9 aa, Homo Sapiens
CGAVHGQQS

SEQ ID NO: 1407504 - protein, 9 aa, Homo Sapiens
CCDPSGLGE

SEQ ID NO: 1407505 - protein, 9 aa, Homo Sapiens
DTSIGNPIH

SEQ ID NO: 1407506 - protein, 9 aa, Homo Sapiens
LKTYDNPDF

SEQ ID NO: 1407507 - protein, 9 aa, Homo Sapiens
ARQSCCLPG

SEQ ID NO: 1407508 - protein, 9 aa, Homo Sapiens
SEENNGQQS

SEQ ID NO: 1407509 - protein, 9 aa, Homo Sapiens
ETLLEVNEN

SEQ ID NO: 1407510 - protein, 9 aa, Homo Sapiens
SSRPKRKYK

SEQ ID NO: 1407511 - protein, 9 aa, Homo Sapiens
EVEDVSDNA

SEQ ID NO: 1407512 - protein, 9 aa, Homo Sapiens
TLRVLRLIT

SEQ ID NO: 1407513 - protein, 9 aa, Homo Sapiens
QYGKSFVHS

SEQ ID NO: 1407514 - protein, 9 aa, Homo Sapiens
IVQVGKEME

SEQ ID NO: 1407515 - protein, 9 aa, Homo Sapiens
IAYSATNID

SEQ ID NO: 1407516 - protein, 9 aa, Homo Sapiens
TEIDKLATE

SEQ ID NO: 1407517 - protein, 9 aa, Homo Sapiens
DDDEDDGDE

SEQ ID NO: 1407518 - protein, 9 aa, Homo Sapiens
FFLTTLLIG

SEQ ID NO: 1407519 - protein, 9 aa, Homo Sapiens
DHTSVLACI

SEQ ID NO: 1407520 - protein, 9 aa, Homo Sapiens
SSPSPSPTS

SEQ ID NO: 1407521 - protein, 9 aa, Homo Sapiens
FLNSQVGCR

SEQ ID NO: 1407522 - protein, 9 aa, Homo Sapiens
TGTWADPQT

SEQ ID NO: 1407523 - protein, 9 aa, Homo Sapiens
KGSGEGEGV

SEQ ID NO: 1407524 - protein, 9 aa, Homo Sapiens
LPGNSLIIF

SEQ ID NO: 1407525 - protein, 9 aa, Homo Sapiens
VLPDRQEHQ

SEQ ID NO: 1407526 - protein, 9 aa, Homo Sapiens
SSCWGLVLP

SEQ ID NO: 1407527 - protein, 9 aa, Homo Sapiens
HHPGVTMHR

SEQ ID NO: 1407528 - protein, 9 aa, Homo Sapiens
HPAHQPLGS

SEQ ID NO: 1407529 - protein, 9 aa, Homo Sapiens
PVQSCSQVG

SEQ ID NO: 1407530 - protein, 9 aa, Homo Sapiens
EIHDTKMRL

SEQ ID NO: 1407531 - protein, 9 aa, Homo Sapiens
VDVRIQLFI

SEQ ID NO: 1407532 - protein, 9 aa, Homo Sapiens
PGTMDSVHS

SEQ ID NO: 1407533 - protein, 9 aa, Homo Sapiens
MLGLRSNRL

SEQ ID NO: 1407534 - protein, 9 aa, Homo Sapiens
FAMRNVCPP

SEQ ID NO: 1407535 - protein, 9 aa, Homo Sapiens
PPGPPMARL

SEQ ID NO: 1407536 - protein, 9 aa, Homo Sapiens
RKVPGLDGD

SEQ ID NO: 1407537 - protein, 9 aa, Homo Sapiens
RNVCPPRGF

SEQ ID NO: 1407538 - protein, 9 aa, Homo Sapiens
RQGHGTSPM

SEQ ID NO: 1407539 - protein, 9 aa, Homo Sapiens
MHPFLALLR

SEQ ID NO: 1407540 - protein, 9 aa, Homo Sapiens
SYYHPVFSK

SEQ ID NO: 1407541 - protein, 9 aa, Homo Sapiens
FQYFFFSVD

SEQ ID NO: 1407542 - protein, 9 aa, Homo Sapiens
MRNVCPPRG

SEQ ID NO: 1407543 - protein, 9 aa, Homo Sapiens
HVHGLPMTR

SEQ ID NO: 1407544 - protein, 9 aa, Homo Sapiens
NKVYKSTSD

SEQ ID NO: 1407545 - protein, 9 aa, Homo Sapiens
VYKSTSDVM

SEQ ID NO: 1407546 - protein, 9 aa, Homo Sapiens
AVPAANTIR

SEQ ID NO: 1407547 - protein, 9 aa, Homo Sapiens
ESDRKFREK

SEQ ID NO: 1407548 - protein, 9 aa, Homo Sapiens
AKFQLSEPP

SEQ ID NO: 1407549 - protein, 9 aa, Homo Sapiens
PFLALLRKV

SEQ ID NO: 1407550 - protein, 9 aa, Homo Sapiens
EKVSCMFIP

SEQ ID NO: 1407551 - protein, 9 aa, Homo Sapiens
DGDTLCCPD

SEQ ID NO: 1407552 - protein, 9 aa, Homo Sapiens
SDGLTNDSF

SEQ ID NO: 1407553 - protein, 9 aa, Homo Sapiens
IPHYLRQSE

SEQ ID NO: 1407554 - protein, 9 aa, Homo Sapiens
GTSPMGDHG

SEQ ID NO: 1407555 - protein, 9 aa, Homo Sapiens
EQQLLGEFE

SEQ ID NO: 1407556 - protein, 9 aa, Homo Sapiens
NRYLQGLVS

SEQ ID NO: 1407557 - protein, 9 aa, Homo Sapiens
DEDEDEDEQ

SEQ ID NO: 1407558 - protein, 9 aa, Homo Sapiens
MLTNVNWTL

SEQ ID NO: 1407559 - protein, 9 aa, Homo Sapiens
NSQVRSQAS

SEQ ID NO: 1407560 - protein, 9 aa, Homo Sapiens
LFIFVLIVC

SEQ ID NO: 1407561 - protein, 9 aa, Homo Sapiens
IRFRCPAAG

SEQ ID NO: 1407562 - protein, 9 aa, Homo Sapiens
IHYNYMCDS

SEQ ID NO: 1407563 - protein, 9 aa, Homo Sapiens
EESEFQRKE

SEQ ID NO: 1407564 - protein, 9 aa, Homo Sapiens
VLEESEFQR

SEQ ID NO: 1407565 - protein, 9 aa, Homo Sapiens
AHLPPGPVR

SEQ ID NO: 1407566 - protein, 9 aa, Homo Sapiens
ISLVGAVEE

SEQ ID NO: 1407567 - protein, 9 aa, Homo Sapiens
ICNRYLQGL

SEQ ID NO: 1407568 - protein, 9 aa, Homo Sapiens
TMDSVHSGP

SEQ ID NO: 1407569 - protein, 9 aa, Homo Sapiens
RIHAKFQLS

SEQ ID NO: 1407570 - protein, 9 aa, Homo Sapiens
HAKFQLSEP

SEQ ID NO: 1407571 - protein, 9 aa, Homo Sapiens
INSQVRSQA

SEQ ID NO: 1407572 - protein, 9 aa, Homo Sapiens
SGGPLICNR

SEQ ID NO: 1407573 - protein, 9 aa, Homo Sapiens
YMCDSSCMG

SEQ ID NO: 1407574 - protein, 9 aa, Homo Sapiens
AWKTKKTSF

SEQ ID NO: 1407575 - protein, 9 aa, Homo Sapiens
PGPPMARLP

SEQ ID NO: 1407576 - protein, 9 aa, Homo Sapiens
YKRHMDSMY

SEQ ID NO: 1407577 - protein, 9 aa, Homo Sapiens
MVYRCDTCG

SEQ ID NO: 1407578 - protein, 9 aa, Homo Sapiens
SDRKFREKE

SEQ ID NO: 1407579 - protein, 9 aa, Homo Sapiens
DGLTNDSFS

SEQ ID NO: 1407580 - protein, 9 aa, Homo Sapiens
RRVDVRIQL

SEQ ID NO: 1407581 - protein, 9 aa, Homo Sapiens
VERAMTKDN

SEQ ID NO: 1407582 - protein, 9 aa, Homo Sapiens
VGKYHIQAC

SEQ ID NO: 1407583 - protein, 9 aa, Homo Sapiens
TQSMRSGAG

SEQ ID NO: 1407584 - protein, 9 aa, Homo Sapiens
LICNRYLQG

SEQ ID NO: 1407585 - protein, 9 aa, Homo Sapiens
HMDSMYGPP

SEQ ID NO: 1407586 - protein, 9 aa, Homo Sapiens
SVDINSQVR

SEQ ID NO: 1407587 - protein, 9 aa, Homo Sapiens
EMVYRCDTC

SEQ ID NO: 1407588 - protein, 9 aa, Homo Sapiens
VYEVERAMT

SEQ ID NO: 1407589 - protein, 9 aa, Homo Sapiens
GLTNDSFSL

SEQ ID NO: 1407590 - protein, 9 aa, Homo Sapiens
CITYCTSDF

SEQ ID NO: 1407591 - protein, 9 aa, Homo Sapiens
SLVGAVEEV

SEQ ID NO: 1407592 - protein, 9 aa, Homo Sapiens
KKEKVSCMF

SEQ ID NO: 1407593 - protein, 9 aa, Homo Sapiens
FLALLRKVP

SEQ ID NO: 1407594 - protein, 9 aa, Homo Sapiens
KEQLRQERE

SEQ ID NO: 1407595 - protein, 9 aa, Homo Sapiens
VLPHNRLPL

SEQ ID NO: 1407596 - protein, 9 aa, Homo Sapiens
LPHNRLPLA

SEQ ID NO: 1407597 - protein, 9 aa, Homo Sapiens
FSKAILARY

SEQ ID NO: 1407598 - protein, 9 aa, Homo Sapiens
GLPMTRYRV

SEQ ID NO: 1407599 - protein, 9 aa, Homo Sapiens
VCPPRGFPP

SEQ ID NO: 1407600 - protein, 9 aa, Homo Sapiens
DEDEQQLLG

SEQ ID NO: 1407601 - protein, 9 aa, Homo Sapiens
PVTTLVLPH

SEQ ID NO: 1407602 - protein, 9 aa, Homo Sapiens
AKKEKVSCM

SEQ ID NO: 1407603 - protein, 9 aa, Homo Sapiens
SKITRDLYV

SEQ ID NO: 1407604 - protein, 9 aa, Homo Sapiens
QLQVKNLNR

SEQ ID NO: 1407605 - protein, 9 aa, Homo Sapiens
HCCITYCTS

SEQ ID NO: 1407606 - protein, 9 aa, Homo Sapiens
ASTQLQVKN

SEQ ID NO: 1407607 - protein, 9 aa, Homo Sapiens
CGVQDLLLP

SEQ ID NO: 1407608 - protein, 9 aa, Homo Sapiens
YCDLPPCPP

SEQ ID NO: 1407609 - protein, 9 aa, Homo Sapiens
RVNTAWKTK

SEQ ID NO: 1407610 - protein, 9 aa, Homo Sapiens
VSAKKEKVS

SEQ ID NO: 1407611 - protein, 9 aa, Homo Sapiens
YNYMCDSSC

SEQ ID NO: 1407612 - protein, 9 aa, Homo Sapiens
PVSAKKEKV

SEQ ID NO: 1407613 - protein, 9 aa, Homo Sapiens
LTLPPSGAA

SEQ ID NO: 1407614 - protein, 9 aa, Homo Sapiens
TSPMGDHGS

SEQ ID NO: 1407615 - protein, 9 aa, Homo Sapiens
FPALTLPPS

SEQ ID NO: 1407616 - protein, 9 aa, Homo Sapiens
GAVEEVGDY

SEQ ID NO: 1407617 - protein, 9 aa, Homo Sapiens
VMFRIHAKF

SEQ ID NO: 1407618 - protein, 9 aa, Homo Sapiens
AAAGISSKI

SEQ ID NO: 1407619 - protein, 9 aa, Homo Sapiens
KVYKSTSDV

SEQ ID NO: 1407620 - protein, 9 aa, Homo Sapiens
IQACTTTPC

SEQ ID NO: 1407621 - protein, 9 aa, Homo Sapiens
LDGDTLCCP

SEQ ID NO: 1407622 - protein, 9 aa, Homo Sapiens
ATSSGTKVP

SEQ ID NO: 1407623 - protein, 9 aa, Homo Sapiens
KVSTDKECG

SEQ ID NO: 1407624 - protein, 9 aa, Homo Sapiens
VPAANTIRF

SEQ ID NO: 1407625 - protein, 9 aa, Homo Sapiens
RGKNANKKM

SEQ ID NO: 1407626 - protein, 9 aa, Homo Sapiens
QGHGTSPMG

SEQ ID NO: 1407627 - protein, 9 aa, Homo Sapiens
ALTLPPSGA

SEQ ID NO: 1407628 - protein, 9 aa, Homo Sapiens
YKSTSDVMT

SEQ ID NO: 1407629 - protein, 9 aa, Homo Sapiens
ITLFKTEKM

SEQ ID NO: 1407630 - protein, 9 aa, Homo Sapiens
CFQYFFFSV

SEQ ID NO: 1407631 - protein, 9 aa, Homo Sapiens
VATEMVYRC

SEQ ID NO: 1407632 - protein, 9 aa, Homo Sapiens
SGAAALSLP

SEQ ID NO: 1407633 - protein, 9 aa, Homo Sapiens
CPPRGFPPY

SEQ ID NO: 1407634 - protein, 9 aa, Homo Sapiens
KKMNKNANG

SEQ ID NO: 1407635 - protein, 9 aa, Homo Sapiens
MCDSSCMGG

SEQ ID NO: 1407636 - protein, 9 aa, Homo Sapiens
NLRMLGLRS

SEQ ID NO: 1407637 - protein, 9 aa, Homo Sapiens
EDEDEQQLL

SEQ ID NO: 1407638 - protein, 9 aa, Homo Sapiens
VDINSQVRS

SEQ ID NO: 1407639 - protein, 9 aa, Homo Sapiens
HIQACTTTP

SEQ ID NO: 1407640 - protein, 9 aa, Homo Sapiens
VHGLPMTRY

SEQ ID NO: 1407641 - protein, 9 aa, Homo Sapiens
MDSMYGPPA

SEQ ID NO: 1407642 - protein, 9 aa, Homo Sapiens
VPYCDLPPC

SEQ ID NO: 1407643 - protein, 9 aa, Homo Sapiens
FCRNLDGSE

SEQ ID NO: 1407644 - protein, 9 aa, Homo Sapiens
SGTKVPPRS

SEQ ID NO: 1407645 - protein, 9 aa, Homo Sapiens
FKASTQLQV

SEQ ID NO: 1407646 - protein, 9 aa, Homo Sapiens
FSLMGDQEY

SEQ ID NO: 1407647 - protein, 9 aa, Homo Sapiens
HPVFSKAIL

SEQ ID NO: 1407648 - protein, 9 aa, Homo Sapiens
SWSAHKPCL

SEQ ID NO: 1407649 - protein, 9 aa, Homo Sapiens
HSGPFGQVL

SEQ ID NO: 1407650 - protein, 9 aa, Homo Sapiens
AYGYGMHPF

SEQ ID NO: 1407651 - protein, 9 aa, Homo Sapiens
DTLCCPDLQ

SEQ ID NO: 1407652 - protein, 9 aa, Homo Sapiens
VFSKAILAR

SEQ ID NO: 1407653 - protein, 9 aa, Homo Sapiens
GEIHDTKMR

SEQ ID NO: 1407654 - protein, 9 aa, Homo Sapiens
FKTVLEESE

SEQ ID NO: 1407655 - protein, 9 aa, Homo Sapiens
CDLPPCPPA

SEQ ID NO: 1407656 - protein, 9 aa, Homo Sapiens
VFIQVYEVE

SEQ ID NO: 1407657 - protein, 9 aa, Homo Sapiens
CCPDLQKLG

SEQ ID NO: 1407658 - protein, 9 aa, Homo Sapiens
FRIHAKFQL

SEQ ID NO: 1407659 - protein, 9 aa, Homo Sapiens
KMNKNANGV

SEQ ID NO: 1407660 - protein, 9 aa, Homo Sapiens
KECGVQDLL

SEQ ID NO: 1407661 - protein, 9 aa, Homo Sapiens
IFVLIVCFQ

SEQ ID NO: 1407662 - protein, 9 aa, Homo Sapiens
FKTEKMLTN

SEQ ID NO: 1407663 - protein, 9 aa, Homo Sapiens
SAHKPCLHL

SEQ ID NO: 1407664 - protein, 9 aa, Homo Sapiens
LPPSGAAAL

SEQ ID NO: 1407665 - protein, 9 aa, Homo Sapiens
LLRKVPGLD

SEQ ID NO: 1407666 - protein, 9 aa, Homo Sapiens
NLFNLRMLG

SEQ ID NO: 1407667 - protein, 9 aa, Homo Sapiens
TNDSFSLMG

SEQ ID NO: 1407668 - protein, 9 aa, Homo Sapiens
PMGDHGSLV

SEQ ID NO: 1407669 - protein, 9 aa, Homo Sapiens
GIPHYLRQS

SEQ ID NO: 1407670 - protein, 9 aa, Homo Sapiens
AMRNVCPPR

SEQ ID NO: 1407671 - protein, 9 aa, Homo Sapiens
AVEEVGDYF

SEQ ID NO: 1407672 - protein, 9 aa, Homo Sapiens
TAWKTKKTS

SEQ ID NO: 1407673 - protein, 9 aa, Homo Sapiens
REKEQLRQE

SEQ ID NO: 1407674 - protein, 9 aa, Homo Sapiens
FREKEQLRQ

SEQ ID NO: 1407675 - protein, 9 aa, Homo Sapiens
GMHPFLALL

SEQ ID NO: 1407676 - protein, 9 aa, Homo Sapiens
VHSGPFGQV

SEQ ID NO: 1407677 - protein, 9 aa, Homo Sapiens
GYGMHPFLA

SEQ ID NO: 1407678 - protein, 9 aa, Homo Sapiens
FSVDINSQV

SEQ ID NO: 1407679 - protein, 9 aa, Homo Sapiens
HDTKMRLEQ

SEQ ID NO: 1407680 - protein, 9 aa, Homo Sapiens
LVGAVEEVG

SEQ ID NO: 1407681 - protein, 9 aa, Homo Sapiens
AHKPCLHLQ

SEQ ID NO: 1407682 - protein, 9 aa, Homo Sapiens
AFKASTQLQ

SEQ ID NO: 1407683 - protein, 9 aa, Homo Sapiens
GGPLICNRY

SEQ ID NO: 1407684 - protein, 9 aa, Homo Sapiens
TLVLPHNRL

SEQ ID NO: 1407685 - protein, 9 aa, Homo Sapiens
TEKMLTNVN

SEQ ID NO: 1407686 - protein, 9 aa, Homo Sapiens
LAVPAANTI

SEQ ID NO: 1407687 - protein, 9 aa, Homo Sapiens
GPPMARLPP

SEQ ID NO: 1407688 - protein, 9 aa, Homo Sapiens
IHDTKMRLE

SEQ ID NO: 1407689 - protein, 9 aa, Homo Sapiens
RKFREKEQL

SEQ ID NO: 1407690 - protein, 9 aa, Homo Sapiens
NYKRHMDSM

SEQ ID NO: 1407691 - protein, 9 aa, Homo Sapiens
KITRDLYVT

SEQ ID NO: 1407692 - protein, 9 aa, Homo Sapiens
LFKTEKMLT

SEQ ID NO: 1407693 - protein, 9 aa, Homo Sapiens
PPCPPAPED

SEQ ID NO: 1407694 - protein, 9 aa, Homo Sapiens
NSYYHPVFS

SEQ ID NO: 1407695 - protein, 9 aa, Homo Sapiens
IHAKFQLSE

SEQ ID NO: 1407696 - protein, 9 aa, Homo Sapiens
YLRQSEDVA

SEQ ID NO: 1407697 - protein, 9 aa, Homo Sapiens
SSKITRDLY

SEQ ID NO: 1407698 - protein, 9 aa, Homo Sapiens
YHIQACTTT

SEQ ID NO: 1407699 - protein, 9 aa, Homo Sapiens
EDEQQLLGE

SEQ ID NO: 1407700 - protein, 9 aa, Homo Sapiens
GRRRVDVRI

SEQ ID NO: 1407701 - protein, 9 aa, Homo Sapiens
PPSGAAALS

SEQ ID NO: 1407702 - protein, 9 aa, Homo Sapiens
TRTSWSAHK

SEQ ID NO: 1407703 - protein, 9 aa, Homo Sapiens
RRRVDVRIQ

SEQ ID NO: 1407704 - protein, 9 aa, Homo Sapiens
NKKMNKNAN

SEQ ID NO: 1407705 - protein, 9 aa, Homo Sapiens
AAGISSKIT

SEQ ID NO: 1407706 - protein, 9 aa, Homo Sapiens
YHPVFSKAI

SEQ ID NO: 1407707 - protein, 9 aa, Homo Sapiens
RQSEDVAEV

SEQ ID NO: 1407708 - protein, 9 aa, Homo Sapiens
DPVTTLVLP

SEQ ID NO: 1407709 - protein, 9 aa, Homo Sapiens
IQVYEVERA

SEQ ID NO: 1407710 - protein, 9 aa, Homo Sapiens
KYHIQACTT

SEQ ID NO: 1407711 - protein, 9 aa, Homo Sapiens
DVRIQLFIF

SEQ ID NO: 1407712 - protein, 9 aa, Homo Sapiens
KFQLSEPPD

SEQ ID NO: 1407713 - protein, 9 aa, Homo Sapiens
PMARLPPGP

SEQ ID NO: 1407714 - protein, 9 aa, Homo Sapiens
CCITYCTSD

SEQ ID NO: 1407715 - protein, 9 aa, Homo Sapiens
FNNLFNLRM

SEQ ID NO: 1407716 - protein, 9 aa, Homo Sapiens
RKAMTKKKR

SEQ ID NO: 1407717 - protein, 9 aa, Homo Sapiens
VLIVCFQYF

SEQ ID NO: 1407718 - protein, 9 aa, Homo Sapiens
YGMHPFLAL

SEQ ID NO: 1407719 - protein, 9 aa, Homo Sapiens
VGCNKVYKS

SEQ ID NO: 1407720 - protein, 9 aa, Homo Sapiens
KRHMDSMYG

SEQ ID NO: 1407721 - protein, 9 aa, Homo Sapiens
DTKMRLEQD

SEQ ID NO: 1407722 - protein, 9 aa, Homo Sapiens
HYNYMCDSS

SEQ ID NO: 1407723 - protein, 9 aa, Homo Sapiens
HPFLALLRK

SEQ ID NO: 1407724 - protein, 9 aa, Homo Sapiens
ACTTTPCML

SEQ ID NO: 1407725 - protein, 9 aa, Homo Sapiens
TVLEESEFQ

SEQ ID NO: 1407726 - protein, 9 aa, Homo Sapiens
TDKECGVQD

SEQ ID NO: 1407727 - protein, 9 aa, Homo Sapiens
EPGTMDSVH

SEQ ID NO: 1407728 - protein, 9 aa, Homo Sapiens
GPVRHAHSI

SEQ ID NO: 1407729 - protein, 9 aa, Homo Sapiens
FIQVYEVER

SEQ ID NO: 1407730 - protein, 9 aa, Homo Sapiens
NDSFSLMGD

SEQ ID NO: 1407731 - protein, 9 aa, Homo Sapiens
GDTLCCPDL

SEQ ID NO: 1407732 - protein, 9 aa, Homo Sapiens
ATEMVYRCD

SEQ ID NO: 1407733 - protein, 9 aa, Homo Sapiens
VHVHGLPMT

SEQ ID NO: 1407734 - protein, 9 aa, Homo Sapiens
KFREKEQLR

SEQ ID NO: 1407735 - protein, 9 aa, Homo Sapiens
TQLQVKNLN

SEQ ID NO: 1407736 - protein, 9 aa, Homo Sapiens
QYFFFSVDI

SEQ ID NO: 1407737 - protein, 9 aa, Homo Sapiens
DRKFREKEQ

SEQ ID NO: 1407738 - protein, 9 aa, Homo Sapiens
PVRHAHSIT

SEQ ID NO: 1407739 - protein, 9 aa, Homo Sapiens
MFRIHAKFQ

SEQ ID NO: 1407740 - protein, 9 aa, Homo Sapiens
KTVLEESEF

SEQ ID NO: 1407741 - protein, 9 aa, Homo Sapiens
ARGKNANKK

SEQ ID NO: 1407742 - protein, 9 aa, Homo Sapiens
DSVHSGPFG

SEQ ID NO: 1407743 - protein, 9 aa, Homo Sapiens
DEDEDEQQL

SEQ ID NO: 1407744 - protein, 9 aa, Homo Sapiens
HYLRQSEDV

SEQ ID NO: 1407745 - protein, 9 aa, Homo Sapiens
WSAHKPCLH

SEQ ID NO: 1407746 - protein, 9 aa, Homo Sapiens
RENFCRNLD

SEQ ID NO: 1407747 - protein, 9 aa, Homo Sapiens
TIHYNYMCD

SEQ ID NO: 1407748 - protein, 9 aa, Homo Sapiens
DEQQLLGEF

SEQ ID NO: 1407749 - protein, 9 aa, Homo Sapiens
DKECGVQDL

SEQ ID NO: 1407750 - protein, 9 aa, Homo Sapiens
FNLRMLGLR

SEQ ID NO: 1407751 - protein, 9 aa, Homo Sapiens
PMTRYRVQY

SEQ ID NO: 1407752 - protein, 9 aa, Homo Sapiens
VRHAHSITT

SEQ ID NO: 1407753 - protein, 9 aa, Homo Sapiens
LGEIHDTKM

SEQ ID NO: 1407754 - protein, 9 aa, Homo Sapiens
YFFFSVDIN

SEQ ID NO: 1407755 - protein, 9 aa, Homo Sapiens
SAKKEKVSC

SEQ ID NO: 1407756 - protein, 9 aa, Homo Sapiens
DINSQVRSQ

SEQ ID NO: 1407757 - protein, 9 aa, Homo Sapiens
PYCDLPPCP

SEQ ID NO: 1407758 - protein, 9 aa, Homo Sapiens
QATSSGTKV

SEQ ID NO: 1407759 - protein, 9 aa, Homo Sapiens
SMYGPPAKR

SEQ ID NO: 1407760 - protein, 9 aa, Homo Sapiens
HGVATEMVY

SEQ ID NO: 1407761 - protein, 9 aa, Homo Sapiens
RHMDSMYGP

SEQ ID NO: 1407762 - protein, 9 aa, Homo Sapiens
YGYGMHPFL

SEQ ID NO: 1407763 - protein, 9 aa, Homo Sapiens
QISLVGAVE

SEQ ID NO: 1407764 - protein, 9 aa, Homo Sapiens
CNKVYKSTS

SEQ ID NO: 1407765 - protein, 9 aa, Homo Sapiens
NANKKMNKN

SEQ ID NO: 1407766 - protein, 9 aa, Homo Sapiens
LFNLRMLGL

SEQ ID NO: 1407767 - protein, 9 aa, Homo Sapiens
LQVKNLNRC

SEQ ID NO: 1407768 - protein, 9 aa, Homo Sapiens
KAMTKKKRV

SEQ ID NO: 1407769 - protein, 9 aa, Homo Sapiens
HKPCLHLQT

SEQ ID NO: 1407770 - protein, 9 aa, Homo Sapiens
PALTLPPSG

SEQ ID NO: 1407771 - protein, 9 aa, Homo Sapiens
KNANKKMNK

SEQ ID NO: 1407772 - protein, 9 aa, Homo Sapiens
TEMVYRCDT

SEQ ID NO: 1407773 - protein, 9 aa, Homo Sapiens
EKMLTNVNW

SEQ ID NO: 1407774 - protein, 9 aa, Homo Sapiens
NTIRFRCPA

SEQ ID NO: 1407775 - protein, 9 aa, Homo Sapiens
EVERAMTKD

SEQ ID NO: 1407776 - protein, 9 aa, Homo Sapiens
RMLGLRSNR

SEQ ID NO: 1407777 - protein, 9 aa, Homo Sapiens
LVLPHNRLP

SEQ ID NO: 1407778 - protein, 9 aa, Homo Sapiens
PHYLRQSED

SEQ ID NO: 1407779 - protein, 9 aa, Homo Sapiens
EKEQLRQER

SEQ ID NO: 1407780 - protein, 9 aa, Homo Sapiens
MDSVHSGPF

SEQ ID NO: 1407781 - protein, 9 aa, Homo Sapiens
SEFQRKEFL

SEQ ID NO: 1407782 - protein, 9 aa, Homo Sapiens
HRHGVATEM

SEQ ID NO: 1407783 - protein, 9 aa, Homo Sapiens
KVPGLDGDT

SEQ ID NO: 1407784 - protein, 9 aa, Homo Sapiens
SFSLMGDQE

SEQ ID NO: 1407785 - protein, 9 aa, Homo Sapiens
LPMTRYRVQ

SEQ ID NO: 1407786 - protein, 9 aa, Homo Sapiens
NTAWKTKKT

SEQ ID NO: 1407787 - protein, 9 aa, Homo Sapiens
PPMARLPPG

SEQ ID NO: 1407788 - protein, 9 aa, Homo Sapiens
TIRFRCPAA

SEQ ID NO: 1407789 - protein, 9 aa, Homo Sapiens
LALLRKVPG

SEQ ID NO: 1407790 - protein, 9 aa, Homo Sapiens
ANKKMNKNA

SEQ ID NO: 1407791 - protein, 9 aa, Homo Sapiens
TLPPSGAAA

SEQ ID NO: 1407792 - protein, 9 aa, Homo Sapiens
TSSGTKVPP

SEQ ID NO: 1407793 - protein, 9 aa, Homo Sapiens
GVATEMVYR

SEQ ID NO: 1407794 - protein, 9 aa, Homo Sapiens
LIVCFQYFF

SEQ ID NO: 1407795 - protein, 9 aa, Homo Sapiens
KTKKTSFSL

SEQ ID NO: 1407796 - protein, 9 aa, Homo Sapiens
DLPPCPPAP

SEQ ID NO: 1407797 - protein, 9 aa, Homo Sapiens
SPMGDHGSL

SEQ ID NO: 1407798 - protein, 9 aa, Homo Sapiens
KKRVNTAWK

SEQ ID NO: 1407799 - protein, 9 aa, Homo Sapiens
VTTLVLPHN

SEQ ID NO: 1407800 - protein, 9 aa, Homo Sapiens
KRVNTAWKT

SEQ ID NO: 1407801 - protein, 9 aa, Homo Sapiens
DSFSLMGDQ

SEQ ID NO: 1407802 - protein, 9 aa, Homo Sapiens
WKTKKTSFS

SEQ ID NO: 1407803 - protein, 9 aa, Homo Sapiens
NNLFNLRML

SEQ ID NO: 1407804 - protein, 9 aa, Homo Sapiens
MGDHGSLVR

SEQ ID NO: 1407805 - protein, 9 aa, Homo Sapiens
RTSWSAHKP

SEQ ID NO: 1407806 - protein, 9 aa, Homo Sapiens
HGTSPMGDH

SEQ ID NO: 1407807 - protein, 9 aa, Homo Sapiens
ESEFQRKEF

SEQ ID NO: 1407808 - protein, 9 aa, Homo Sapiens
RLGEIHDTK

SEQ ID NO: 1407809 - protein, 9 aa, Homo Sapiens
NYMCDSSCM

SEQ ID NO: 1407810 - protein, 9 aa, Homo Sapiens
EDEDEDEQQ

SEQ ID NO: 1407811 - protein, 9 aa, Homo Sapiens
DSSCMGGMN

SEQ ID NO: 1407812 - protein, 9 aa, Homo Sapiens
FFSVDINSQ

SEQ ID NO: 1407813 - protein, 9 aa, Homo Sapiens
GISSKITRD

SEQ ID NO: 1407814 - protein, 9 aa, Homo Sapiens
GLDGDTLCC

SEQ ID NO: 1407815 - protein, 9 aa, Homo Sapiens
ANTIRFRCP

SEQ ID NO: 1407816 - protein, 9 aa, Homo Sapiens
LRMLGLRSN

SEQ ID NO: 1407817 - protein, 9 aa, Homo Sapiens
CNRYLQGLV

SEQ ID NO: 1407818 - protein, 9 aa, Homo Sapiens
SEDVAEVLN

SEQ ID NO: 1407819 - protein, 9 aa, Homo Sapiens
VNTAWKTKK

SEQ ID NO: 1407820 - protein, 9 aa, Homo Sapiens
KTTQSMRSG

SEQ ID NO: 1407821 - protein, 9 aa, Homo Sapiens
QSMRSGAGV

SEQ ID NO: 1407822 - protein, 9 aa, Homo Sapiens
RIQLFIFVL

SEQ ID NO: 1407823 - protein, 9 aa, Homo Sapiens
MAAAGISSK

SEQ ID NO: 1407824 - protein, 9 aa, Homo Sapiens
VPGLDGDTL

SEQ ID NO: 1407825 - protein, 9 aa, Homo Sapiens
HLPPGPVRH

SEQ ID NO: 1407826 - protein, 9 aa, Homo Sapiens
LEESEFQRK

SEQ ID NO: 1407827 - protein, 9 aa, Homo Sapiens
TVHVHGLPM

SEQ ID NO: 1407828 - protein, 9 aa, Homo Sapiens
SMRSGAGVQ

SEQ ID NO: 1407829 - protein, 9 aa, Homo Sapiens
FFFSVDINS

SEQ ID NO: 1407830 - protein, 9 aa, Homo Sapiens
KSTSDVMTH

SEQ ID NO: 1407831 - protein, 9 aa, Homo Sapiens
MRSGAGVQA

SEQ ID NO: 1407832 - protein, 9 aa, Homo Sapiens
HGLPMTRYR

SEQ ID NO: 1407833 - protein, 9 aa, Homo Sapiens
EVPYCDLPP

SEQ ID NO: 1407834 - protein, 9 aa, Homo Sapiens
TVMFRIHAK

SEQ ID NO: 1407835 - protein, 9 aa, Homo Sapiens
KKKRVNTAW

SEQ ID NO: 1407836 - protein, 9 aa, Homo Sapiens
KEKVSCMFI

SEQ ID NO: 1407837 - protein, 9 aa, Homo Sapiens
QVYEVERAM

SEQ ID NO: 1407838 - protein, 9 aa, Homo Sapiens
MARLPPGPP

SEQ ID NO: 1407839 - protein, 9 aa, Homo Sapiens
GKNANKKMN

SEQ ID NO: 1407840 - protein, 9 aa, Homo Sapiens
RYLQGLVSF

SEQ ID NO: 1407841 - protein, 9 aa, Homo Sapiens
ENFCRNLDG

SEQ ID NO: 1407842 - protein, 9 aa, Homo Sapiens
YEVERAMTK

SEQ ID NO: 1407843 - protein, 9 aa, Homo Sapiens
PNYKRHMDS

SEQ ID NO: 1407844 - protein, 9 aa, Homo Sapiens
PAANTIRFR

SEQ ID NO: 1407845 - protein, 9 aa, Homo Sapiens
SRLGEIHDT

SEQ ID NO: 1407846 - protein, 9 aa, Homo Sapiens
PVGKYHIQA

SEQ ID NO: 1407847 - protein, 9 aa, Homo Sapiens
GPQATSSGT

SEQ ID NO: 1407848 - protein, 9 aa, Homo Sapiens
ITYCTSDFP

SEQ ID NO: 1407849 - protein, 9 aa, Homo Sapiens
FIFVLIVCF

SEQ ID NO: 1407850 - protein, 9 aa, Homo Sapiens
RVDVRIQLF

SEQ ID NO: 1407851 - protein, 9 aa, Homo Sapiens
VEEVGDYFP

SEQ ID NO: 1407852 - protein, 9 aa, Homo Sapiens
QVGCNKVYK

SEQ ID NO: 1407853 - protein, 9 aa, Homo Sapiens
ALLRKVPGL

SEQ ID NO: 1407854 - protein, 9 aa, Homo Sapiens
AMTKKKRVN

SEQ ID NO: 1407855 - protein, 9 aa, Homo Sapiens
CDSSCMGGM

SEQ ID NO: 1407856 - protein, 9 aa, Homo Sapiens
VSTDKECGV

SEQ ID NO: 1407857 - protein, 9 aa, Homo Sapiens
AANTIRFRC

SEQ ID NO: 1407858 - protein, 9 aa, Homo Sapiens
GCNKVYKST

SEQ ID NO: 1407859 - protein, 9 aa, Homo Sapiens
LCCPDLQKL

SEQ ID NO: 1407860 - protein, 9 aa, Homo Sapiens
PHNRLPLAV

SEQ ID NO: 1407861 - protein, 9 aa, Homo Sapiens
TKMRLEQDL

SEQ ID NO: 1407862 - protein, 9 aa, Homo Sapiens
TTLVLPHNR

SEQ ID NO: 1407863 - protein, 9 aa, Homo Sapiens
VGAVEEVGD

SEQ ID NO: 1407864 - protein, 9 aa, Homo Sapiens
KMLTNVNWT

SEQ ID NO: 1407865 - protein, 9 aa, Homo Sapiens
SVHSGPFGQ

SEQ ID NO: 1407866 - protein, 9 aa, Homo Sapiens
LRENFCRNL

SEQ ID NO: 1407867 - protein, 9 aa, Homo Sapiens
PKTTQSMRS

SEQ ID NO: 1407868 - protein, 9 aa, Homo Sapiens
QACTTTPCM

SEQ ID NO: 1407869 - protein, 9 aa, Homo Sapiens
YYHPVFSKA

SEQ ID NO: 1407870 - protein, 9 aa, Homo Sapiens
VCFQYFFFS

SEQ ID NO: 1407871 - protein, 9 aa, Homo Sapiens
QLFIFVLIV

SEQ ID NO: 1407872 - protein, 9 aa, Homo Sapiens
DSMYGPPAK

SEQ ID NO: 1407873 - protein, 9 aa, Homo Sapiens
GVFIQVYEV

SEQ ID NO: 1407874 - protein, 9 aa, Homo Sapiens
PSGAAALSL

SEQ ID NO: 1407875 - protein, 9 aa, Homo Sapiens
LRQSEDVAE

SEQ ID NO: 1407876 - protein, 9 aa, Homo Sapiens
GTMDSVHSG

SEQ ID NO: 1407877 - protein, 9 aa, Homo Sapiens
KTEKMLTNV

SEQ ID NO: 1407878 - protein, 9 aa, Homo Sapiens
IVCFQYFFF

SEQ ID NO: 1407879 - protein, 9 aa, Homo Sapiens
MTKKKRVNT

SEQ ID NO: 1407880 - protein, 9 aa, Homo Sapiens
PVFSKAILA

SEQ ID NO: 1407881 - protein, 9 aa, Homo Sapiens
LPPGPVRHA

SEQ ID NO: 1407882 - protein, 9 aa, Homo Sapiens
PQATSSGTK

SEQ ID NO: 1407883 - protein, 9 aa, Homo Sapiens
TSWSAHKPC

SEQ ID NO: 1407884 - protein, 9 aa, Homo Sapiens
ISSKITRDL

SEQ ID NO: 1407885 - protein, 9 aa, Homo Sapiens
LHCCITYCT

SEQ ID NO: 1407886 - protein, 9 aa, Homo Sapiens
SGAGVQAAH

SEQ ID NO: 1407887 - protein, 9 aa, Homo Sapiens
AGISSKITR

SEQ ID NO: 1407888 - protein, 9 aa, Homo Sapiens
FVLIVCFQY

SEQ ID NO: 1407889 - protein, 9 aa, Homo Sapiens
NVCPPRGFP

SEQ ID NO: 1407890 - protein, 9 aa, Homo Sapiens
QSEDVAEVL

SEQ ID NO: 1407891 - protein, 9 aa, Homo Sapiens
RAHLPPGPV

SEQ ID NO: 1407892 - protein, 9 aa, Homo Sapiens
QQLLGEFEK

SEQ ID NO: 1407893 - protein, 9 aa, Homo Sapiens
LKVSTDKEC

SEQ ID NO: 1407894 - protein, 9 aa, Homo Sapiens
LRKVPGLDG

SEQ ID NO: 1407895 - protein, 9 aa, Homo Sapiens
CRNLDGSEA

SEQ ID NO: 1407896 - protein, 9 aa, Homo Sapiens
SSGTKVPPR

SEQ ID NO: 1407897 - protein, 9 aa, Homo Sapiens
STQLQVKNL

SEQ ID NO: 1407898 - protein, 9 aa, Homo Sapiens
LPPCPPAPE

SEQ ID NO: 1407899 - protein, 9 aa, Homo Sapiens
PLICNRYLQ

SEQ ID NO: 1407900 - protein, 9 aa, Homo Sapiens
VAFKASTQL

SEQ ID NO: 1407901 - protein, 9 aa, Homo Sapiens
TKKKRVNTA

SEQ ID NO: 1407902 - protein, 9 aa, Homo Sapiens
PGPVRHAHS

SEQ ID NO: 1407903 - protein, 9 aa, Homo Sapiens
RLPPGPPMA

SEQ ID NO: 1407904 - protein, 9 aa, Homo Sapiens
RHGVATEMV

SEQ ID NO: 1407905 - protein, 9 aa, Homo Sapiens
LTNDSFSLM

SEQ ID NO: 1407906 - protein, 9 aa, Homo Sapiens
RNLDGSEAP

SEQ ID NO: 1407907 - protein, 9 aa, Homo Sapiens
KASTQLQVK

SEQ ID NO: 1407908 - protein, 9 aa, Homo Sapiens
NFCRNLDGS

SEQ ID NO: 1407909 - protein, 9 aa, Homo Sapiens
GHGTSPMGD

SEQ ID NO: 1407910 - protein, 9 aa, Homo Sapiens
VRIQLFIFV

SEQ ID NO: 1407911 - protein, 9 aa, Homo Sapiens
IQLFIFVLI

SEQ ID NO: 1407912 - protein, 9 aa, Homo Sapiens
TKVPPRSPR

SEQ ID NO: 1407913 - protein, 9 aa, Homo Sapiens
ARLPPGPPM

SEQ ID NO: 1407914 - protein, 9 aa, Homo Sapiens
SKAILARYR

SEQ ID NO: 1407915 - protein, 9 aa, Homo Sapiens
TLFKTEKML

SEQ ID NO: 1407916 - protein, 9 aa, Homo Sapiens
ECGVQDLLL

SEQ ID NO: 1407917 - protein, 9 aa, Homo Sapiens
GKYHIQACT

SEQ ID NO: 1407918 - protein, 9 aa, Homo Sapiens
MTRYRVQYS

SEQ ID NO: 1407919 - protein, 9 aa, Homo Sapiens
STDKECGVQ

SEQ ID NO: 1407920 - protein, 9 aa, Homo Sapiens
RSGAGVQAA

SEQ ID NO: 1407921 - protein, 9 aa, Homo Sapiens
GTKVPPRSP

SEQ ID NO: 1407922 - protein, 9 aa, Homo Sapiens
TTQSMRSGA

SEQ ID NO: 1407923 - protein, 9 aa, Homo Sapiens
TLCCPDLQK

SEQ ID NO: 1407924 - protein, 9 aa, Homo Sapiens
PGLDGDTLC

SEQ ID NO: 1407925 - protein, 9 aa, Homo Sapiens
GPLICNRYL

SEQ ID NO: 1407926 - protein, 9 aa, Homo Sapiens
PCPPAPEDP

SEQ ID NO: 1407927 - protein, 9 aa, Homo Sapiens
AFKTVLEES

SEQ ID NO: 1407928 - protein, 9 aa, Homo Sapiens
KPCLHLQTG

SEQ ID NO: 1407929 - protein, 9 aa, Homo Sapiens
PPGPVRHAH

SEQ ID NO: 1407930 - protein, 9 aa, Homo Sapiens
YSYTASSVI

SEQ ID NO: 1407931 - protein, 9 aa, Homo Sapiens
NLFINLFSI

SEQ ID NO: 1407932 - protein, 9 aa, Homo Sapiens
SFANPLPSM

SEQ ID NO: 1407933 - protein, 9 aa, Homo Sapiens
EDQGIFQNG

SEQ ID NO: 1407934 - protein, 9 aa, Homo Sapiens
AVSYTTSLY

SEQ ID NO: 1407935 - protein, 9 aa, Homo Sapiens
LLLKDCRCR

SEQ ID NO: 1407936 - protein, 9 aa, Homo Sapiens
VTIPDNDNE

SEQ ID NO: 1407937 - protein, 9 aa, Homo Sapiens
QIADEVVWV

SEQ ID NO: 1407938 - protein, 9 aa, Homo Sapiens
DKHILGFDK

SEQ ID NO: 1407939 - protein, 9 aa, Homo Sapiens
ALTAGLRRL

SEQ ID NO: 1407940 - protein, 9 aa, Homo Sapiens
STDTIKYVS

SEQ ID NO: 1407941 - protein, 9 aa, Homo Sapiens
SVSTDTIKY

SEQ ID NO: 1407942 - protein, 9 aa, Homo Sapiens
GDDNTNGKD

SEQ ID NO: 1407943 - protein, 9 aa, Homo Sapiens
SLASLSSHS

SEQ ID NO: 1407944 - protein, 9 aa, Homo Sapiens
DEETAIQTV

SEQ ID NO: 1407945 - protein, 9 aa, Homo Sapiens
INLFSIMLG

SEQ ID NO: 1407946 - protein, 9 aa, Homo Sapiens
PSKKKLKLA

SEQ ID NO: 1407947 - protein, 9 aa, Homo Sapiens
EEKGNQETA

SEQ ID NO: 1407948 - protein, 9 aa, Homo Sapiens
LALDVDRMK

SEQ ID NO: 1407949 - protein, 9 aa, Homo Sapiens
IADEVVWVR

SEQ ID NO: 1407950 - protein, 9 aa, Homo Sapiens
PMPDDFPNF

SEQ ID NO: 1407951 - protein, 9 aa, Homo Sapiens
PLQVTTTLK

SEQ ID NO: 1407952 - protein, 9 aa, Homo Sapiens
RQFFKDRWN

SEQ ID NO: 1407953 - protein, 9 aa, Homo Sapiens
SLNLFMAVY

SEQ ID NO: 1407954 - protein, 9 aa, Homo Sapiens
SSLASSQAK

SEQ ID NO: 1407955 - protein, 9 aa, Homo Sapiens
EVTFYLGEE

SEQ ID NO: 1407956 - protein, 9 aa, Homo Sapiens
DFAKRCEDA

SEQ ID NO: 1407957 - protein, 9 aa, Homo Sapiens
LSSHSSLSS

SEQ ID NO: 1407958 - protein, 9 aa, Homo Sapiens
VTFYLGEET

SEQ ID NO: 1407959 - protein, 9 aa, Homo Sapiens
FFGSSATQA

SEQ ID NO: 1407960 - protein, 9 aa, Homo Sapiens
LCMFRPCED

SEQ ID NO: 1407961 - protein, 9 aa, Homo Sapiens
AQTAGKIIR

SEQ ID NO: 1407962 - protein, 9 aa, Homo Sapiens
CCLSAKNMS

SEQ ID NO: 1407963 - protein, 9 aa, Homo Sapiens
RSSRQSSIV

SEQ ID NO: 1407964 - protein, 9 aa, Homo Sapiens
KTVILFKVL

SEQ ID NO: 1407965 - protein, 9 aa, Homo Sapiens
DEIIKAAAK

SEQ ID NO: 1407966 - protein, 9 aa, Homo Sapiens
LRLCFKDFA

SEQ ID NO: 1407967 - protein, 9 aa, Homo Sapiens
LVEEITEVN

SEQ ID NO: 1407968 - protein, 9 aa, Homo Sapiens
KNNSDHMWR

SEQ ID NO: 1407969 - protein, 9 aa, Homo Sapiens
PLFEAVGKK

SEQ ID NO: 1407970 - protein, 9 aa, Homo Sapiens
RLFINRSFH

SEQ ID NO: 1407971 - protein, 9 aa, Homo Sapiens
LGFDKGDAV

SEQ ID NO: 1407972 - protein, 9 aa, Homo Sapiens
VIVQCCLSA

SEQ ID NO: 1407973 - protein, 9 aa, Homo Sapiens
ESCCSPSCC

SEQ ID NO: 1407974 - protein, 9 aa, Homo Sapiens
NKEFVEKKF

SEQ ID NO: 1407975 - protein, 9 aa, Homo Sapiens
LYRNKDNEK

SEQ ID NO: 1407976 - protein, 9 aa, Homo Sapiens
TLKLILVML

SEQ ID NO: 1407977 - protein, 9 aa, Homo Sapiens
KIHKDSLGS

SEQ ID NO: 1407978 - protein, 9 aa, Homo Sapiens
KLQKELWQI

SEQ ID NO: 1407979 - protein, 9 aa, Homo Sapiens
IIKAAAKES

SEQ ID NO: 1407980 - protein, 9 aa, Homo Sapiens
ICMTIRKNE

SEQ ID NO: 1407981 - protein, 9 aa, Homo Sapiens
CVTLCMFRP

SEQ ID NO: 1407982 - protein, 9 aa, Homo Sapiens
VSTDTIKYV

SEQ ID NO: 1407983 - protein, 9 aa, Homo Sapiens
GRLFINRSF

SEQ ID NO: 1407984 - protein, 9 aa, Homo Sapiens
EARARQLSP

SEQ ID NO: 1407985 - protein, 9 aa, Homo Sapiens
WPALSRTAR

SEQ ID NO: 1407986 - protein, 9 aa, Homo Sapiens
LTIQIADEV

SEQ ID NO: 1407987 - protein, 9 aa, Homo Sapiens
APPVGLTRV

SEQ ID NO: 1407988 - protein, 9 aa, Homo Sapiens
PPSHAARES

SEQ ID NO: 1407989 - protein, 9 aa, Homo Sapiens
MHRASAPEQ

SEQ ID NO: 1407990 - protein, 9 aa, Homo Sapiens
EVDAAPPVG

SEQ ID NO: 1407991 - protein, 9 aa, Homo Sapiens
SDHMWRLPF

SEQ ID NO: 1407992 - protein, 9 aa, Homo Sapiens
ALDVDRMKK

SEQ ID NO: 1407993 - protein, 9 aa, Homo Sapiens
PVSSALTAG

SEQ ID NO: 1407994 - protein, 9 aa, Homo Sapiens
IICNPSETS

SEQ ID NO: 1407995 - protein, 9 aa, Homo Sapiens
QSLASLSSH

SEQ ID NO: 1407996 - protein, 9 aa, Homo Sapiens
RNKDNEKYP

SEQ ID NO: 1407997 - protein, 9 aa, Homo Sapiens
LVNIGCKKK

SEQ ID NO: 1407998 - protein, 9 aa, Homo Sapiens
VHIRDDGRW

SEQ ID NO: 1407999 - protein, 9 aa, Homo Sapiens
IIQETQMAK

SEQ ID NO: 1408000 - protein, 9 aa, Homo Sapiens
AFGFRQFFK

SEQ ID NO: 1408001 - protein, 9 aa, Homo Sapiens
RYSDFKKLQ

SEQ ID NO: 1408002 - protein, 9 aa, Homo Sapiens
GVILFPDIK

SEQ ID NO: 1408003 - protein, 9 aa, Homo Sapiens
IMLGSGMPE

SEQ ID NO: 1408004 - protein, 9 aa, Homo Sapiens
FARCPPSHA

SEQ ID NO: 1408005 - protein, 9 aa, Homo Sapiens
LPSMKITQV

SEQ ID NO: 1408006 - protein, 9 aa, Homo Sapiens
KPNTVFKLK

SEQ ID NO: 1408007 - protein, 9 aa, Homo Sapiens
YTASSVIYN

SEQ ID NO: 1408008 - protein, 9 aa, Homo Sapiens
NIICNPSET

SEQ ID NO: 1408009 - protein, 9 aa, Homo Sapiens
SYTTSLYFL

SEQ ID NO: 1408010 - protein, 9 aa, Homo Sapiens
LSRLPLPPL

SEQ ID NO: 1408011 - protein, 9 aa, Homo Sapiens
ISSLKSQVI

SEQ ID NO: 1408012 - protein, 9 aa, Homo Sapiens
ASSVIYNIH

SEQ ID NO: 1408013 - protein, 9 aa, Homo Sapiens
ILVMLEIVT

SEQ ID NO: 1408014 - protein, 9 aa, Homo Sapiens
LFEAVGKKF

SEQ ID NO: 1408015 - protein, 9 aa, Homo Sapiens
HILGFDKGD

SEQ ID NO: 1408016 - protein, 9 aa, Homo Sapiens
FFFGSSATQ

SEQ ID NO: 1408017 - protein, 9 aa, Homo Sapiens
PSNTVNFRK

SEQ ID NO: 1408018 - protein, 9 aa, Homo Sapiens
RLCFKDFAK

SEQ ID NO: 1408019 - protein, 9 aa, Homo Sapiens
DEPGRPRHI

SEQ ID NO: 1408020 - protein, 9 aa, Homo Sapiens
QILRNIIQE

SEQ ID NO: 1408021 - protein, 9 aa, Homo Sapiens
INRSFHISA

SEQ ID NO: 1408022 - protein, 9 aa, Homo Sapiens
IGCKKKTIS

SEQ ID NO: 1408023 - protein, 9 aa, Homo Sapiens
THLPVTDTS

SEQ ID NO: 1408024 - protein, 9 aa, Homo Sapiens
KMSVASTEE

SEQ ID NO: 1408025 - protein, 9 aa, Homo Sapiens
HKDSLGSKQ

SEQ ID NO: 1408026 - protein, 9 aa, Homo Sapiens
SETLQKNKK

SEQ ID NO: 1408027 - protein, 9 aa, Homo Sapiens
CHGNLVEEI

SEQ ID NO: 1408028 - protein, 9 aa, Homo Sapiens
GLSRLPLPP

SEQ ID NO: 1408029 - protein, 9 aa, Homo Sapiens
NLGNACYMN

SEQ ID NO: 1408030 - protein, 9 aa, Homo Sapiens
PDTESGYTE

SEQ ID NO: 1408031 - protein, 9 aa, Homo Sapiens
AIVSISALS

SEQ ID NO: 1408032 - protein, 9 aa, Homo Sapiens
VDMTLDAYT

SEQ ID NO: 1408033 - protein, 9 aa, Homo Sapiens
SCCSPSCCQ

SEQ ID NO: 1408034 - protein, 9 aa, Homo Sapiens
FVLLLSAIV

SEQ ID NO: 1408035 - protein, 9 aa, Homo Sapiens
ITTPSKKKL

SEQ ID NO: 1408036 - protein, 9 aa, Homo Sapiens
KKNMHRASA

SEQ ID NO: 1408037 - protein, 9 aa, Homo Sapiens
IVQCCLSAK

SEQ ID NO: 1408038 - protein, 9 aa, Homo Sapiens
EISAGEGTG

SEQ ID NO: 1408039 - protein, 9 aa, Homo Sapiens
LFKVLLTVQ

SEQ ID NO: 1408040 - protein, 9 aa, Homo Sapiens
TTLDPHYVL

SEQ ID NO: 1408041 - protein, 9 aa, Homo Sapiens
GETEYKIEW

SEQ ID NO: 1408042 - protein, 9 aa, Homo Sapiens
NIIQETQMA

SEQ ID NO: 1408043 - protein, 9 aa, Homo Sapiens
VIERTFHLD

SEQ ID NO: 1408044 - protein, 9 aa, Homo Sapiens
TPRMREIQI

SEQ ID NO: 1408045 - protein, 9 aa, Homo Sapiens
LNSSLLPEK

SEQ ID NO: 1408046 - protein, 9 aa, Homo Sapiens
QVTTTLKLI

SEQ ID NO: 1408047 - protein, 9 aa, Homo Sapiens
SARGVILFP

SEQ ID NO: 1408048 - protein, 9 aa, Homo Sapiens
LPDIENEDI

SEQ ID NO: 1408049 - protein, 9 aa, Homo Sapiens
PPPPPVPPL

SEQ ID NO: 1408050 - protein, 9 aa, Homo Sapiens
IACSKALLE

SEQ ID NO: 1408051 - protein, 9 aa, Homo Sapiens
FPTLKYFKK

SEQ ID NO: 1408052 - protein, 9 aa, Homo Sapiens
HGNLVEEIT

SEQ ID NO: 1408053 - protein, 9 aa, Homo Sapiens
NNSDHMWRL

SEQ ID NO: 1408054 - protein, 9 aa, Homo Sapiens
PRPTDNCFS

SEQ ID NO: 1408055 - protein, 9 aa, Homo Sapiens
ILGFDKGDA

SEQ ID NO: 1408056 - protein, 9 aa, Homo Sapiens
EPGRPRHIN

SEQ ID NO: 1408057 - protein, 9 aa, Homo Sapiens
GESSLASSQ

SEQ ID NO: 1408058 - protein, 9 aa, Homo Sapiens
PALSRTARR

SEQ ID NO: 1408059 - protein, 9 aa, Homo Sapiens
KKKNMHRAS

SEQ ID NO: 1408060 - protein, 9 aa, Homo Sapiens
HEFSWIIPR

SEQ ID NO: 1408061 - protein, 9 aa, Homo Sapiens
TEGETEYKI

SEQ ID NO: 1408062 - protein, 9 aa, Homo Sapiens
DIENEDIIK

SEQ ID NO: 1408063 - protein, 9 aa, Homo Sapiens
YTANNFLLI

SEQ ID NO: 1408064 - protein, 9 aa, Homo Sapiens
HDMEVTFYL

SEQ ID NO: 1408065 - protein, 9 aa, Homo Sapiens
TQAMHFPES

SEQ ID NO: 1408066 - protein, 9 aa, Homo Sapiens
DIACSKALL

SEQ ID NO: 1408067 - protein, 9 aa, Homo Sapiens
DKPSNTVNF

SEQ ID NO: 1408068 - protein, 9 aa, Homo Sapiens
IAVSYTTSL

SEQ ID NO: 1408069 - protein, 9 aa, Homo Sapiens
RQLSPQLGP

SEQ ID NO: 1408070 - protein, 9 aa, Homo Sapiens
AGEGTGLAG

SEQ ID NO: 1408071 - protein, 9 aa, Homo Sapiens
NKPNTVFKL

SEQ ID NO: 1408072 - protein, 9 aa, Homo Sapiens
CRCRSRLFP

SEQ ID NO: 1408073 - protein, 9 aa, Homo Sapiens
KYFKKGEKY

SEQ ID NO: 1408074 - protein, 9 aa, Homo Sapiens
QEKKNNSDH

SEQ ID NO: 1408075 - protein, 9 aa, Homo Sapiens
GRIAERSVC

SEQ ID NO: 1408076 - protein, 9 aa, Homo Sapiens
DDGRWATIS

SEQ ID NO: 1408077 - protein, 9 aa, Homo Sapiens
FSDFPMPDD

SEQ ID NO: 1408078 - protein, 9 aa, Homo Sapiens
IPTVDRTLC

SEQ ID NO: 1408079 - protein, 9 aa, Homo Sapiens
MSVASTEEE

SEQ ID NO: 1408080 - protein, 9 aa, Homo Sapiens
GLGQESCCS

SEQ ID NO: 1408081 - protein, 9 aa, Homo Sapiens
NIGCKKKTI

SEQ ID NO: 1408082 - protein, 9 aa, Homo Sapiens
TTPSKKKLK

SEQ ID NO: 1408083 - protein, 9 aa, Homo Sapiens
KPSNTVNFR

SEQ ID NO: 1408084 - protein, 9 aa, Homo Sapiens
LEMQIECQK

SEQ ID NO: 1408085 - protein, 9 aa, Homo Sapiens
QVIFLQKRA

SEQ ID NO: 1408086 - protein, 9 aa, Homo Sapiens
RHINEEVET

SEQ ID NO: 1408087 - protein, 9 aa, Homo Sapiens
HATHLPVTD

SEQ ID NO: 1408088 - protein, 9 aa, Homo Sapiens
EQQQQQPLL

SEQ ID NO: 1408089 - protein, 9 aa, Homo Sapiens
QSETLQKNK

SEQ ID NO: 1408090 - protein, 9 aa, Homo Sapiens
KGDAVLNEA

SEQ ID NO: 1408091 - protein, 9 aa, Homo Sapiens
DKGDAVLNE

SEQ ID NO: 1408092 - protein, 9 aa, Homo Sapiens
PLLLLALGT

SEQ ID NO: 1408093 - protein, 9 aa, Homo Sapiens
LGEETVRIT

SEQ ID NO: 1408094 - protein, 9 aa, Homo Sapiens
SRTARRHPW

SEQ ID NO: 1408095 - protein, 9 aa, Homo Sapiens
GLRNLGNAC

SEQ ID NO: 1408096 - protein, 9 aa, Homo Sapiens
DIIKDCVRI

SEQ ID NO: 1408097 - protein, 9 aa, Homo Sapiens
VILFPDIKI

SEQ ID NO: 1408098 - protein, 9 aa, Homo Sapiens
KVTICMTIR

SEQ ID NO: 1408099 - protein, 9 aa, Homo Sapiens
ADKPSNTVN

SEQ ID NO: 1408100 - protein, 9 aa, Homo Sapiens
IAERSVCGR

SEQ ID NO: 1408101 - protein, 9 aa, Homo Sapiens
ACSKALLER

SEQ ID NO: 1408102 - protein, 9 aa, Homo Sapiens
KIEWQKGAP

SEQ ID NO: 1408103 - protein, 9 aa, Homo Sapiens
FINLFSIML

SEQ ID NO: 1408104 - protein, 9 aa, Homo Sapiens
SHAARESLQ

SEQ ID NO: 1408105 - protein, 9 aa, Homo Sapiens
IRDDGRWAT

SEQ ID NO: 1408106 - protein, 9 aa, Homo Sapiens
QGWDPNVNL

SEQ ID NO: 1408107 - protein, 9 aa, Homo Sapiens
YFKKGEKYA

SEQ ID NO: 1408108 - protein, 9 aa, Homo Sapiens
ANPLPSMKI

SEQ ID NO: 1408109 - protein, 9 aa, Homo Sapiens
LAGTVKDIV

SEQ ID NO: 1408110 - protein, 9 aa, Homo Sapiens
ILQEKKNNS

SEQ ID NO: 1408111 - protein, 9 aa, Homo Sapiens
VNKPNTVFK

SEQ ID NO: 1408112 - protein, 9 aa, Homo Sapiens
LATKNIICN

SEQ ID NO: 1408113 - protein, 9 aa, Homo Sapiens
TGESGAGPG

SEQ ID NO: 1408114 - protein, 9 aa, Homo Sapiens
RSVCGRCHT

SEQ ID NO: 1408115 - protein, 9 aa, Homo Sapiens
GLRRLVTVY

SEQ ID NO: 1408116 - protein, 9 aa, Homo Sapiens
LNCVTLCMF

SEQ ID NO: 1408117 - protein, 9 aa, Homo Sapiens
AMHFPESNT

SEQ ID NO: 1408118 - protein, 9 aa, Homo Sapiens
HAARESLQE

SEQ ID NO: 1408119 - protein, 9 aa, Homo Sapiens
NSSLLPEKQ

SEQ ID NO: 1408120 - protein, 9 aa, Homo Sapiens
NLFMAVYKL

SEQ ID NO: 1408121 - protein, 9 aa, Homo Sapiens
RCPPSHAAR

SEQ ID NO: 1408122 - protein, 9 aa, Homo Sapiens
GAHGESSLA

SEQ ID NO: 1408123 - protein, 9 aa, Homo Sapiens
KDNEKYPNV

SEQ ID NO: 1408124 - protein, 9 aa, Homo Sapiens
TVDRTLCCF

SEQ ID NO: 1408125 - protein, 9 aa, Homo Sapiens
VSSALTAGL

SEQ ID NO: 1408126 - protein, 9 aa, Homo Sapiens
LDTPEEREE

SEQ ID NO: 1408127 - protein, 9 aa, Homo Sapiens
LSLGTTLDP

SEQ ID NO: 1408128 - protein, 9 aa, Homo Sapiens
SQETQISNH

SEQ ID NO: 1408129 - protein, 9 aa, Homo Sapiens
TFYLGEETV

SEQ ID NO: 1408130 - protein, 9 aa, Homo Sapiens
RNLGNACYM

SEQ ID NO: 1408131 - protein, 9 aa, Homo Sapiens
TIQIADEVV

SEQ ID NO: 1408132 - protein, 9 aa, Homo Sapiens
QFFKDRWNQ

SEQ ID NO: 1408133 - protein, 9 aa, Homo Sapiens
DVDRMKKDQ

SEQ ID NO: 1408134 - protein, 9 aa, Homo Sapiens
TDTIKYVSA

SEQ ID NO: 1408135 - protein, 9 aa, Homo Sapiens
LKQSLNLFM

SEQ ID NO: 1408136 - protein, 9 aa, Homo Sapiens
HSSPGSTQA

SEQ ID NO: 1408137 - protein, 9 aa, Homo Sapiens
RSSDSKIHK

SEQ ID NO: 1408138 - protein, 9 aa, Homo Sapiens
LTDEIIKAA

SEQ ID NO: 1408139 - protein, 9 aa, Homo Sapiens
QISNHLDEV

SEQ ID NO: 1408140 - protein, 9 aa, Homo Sapiens
KLAPLQVTT

SEQ ID NO: 1408141 - protein, 9 aa, Homo Sapiens
KDIACSKAL

SEQ ID NO: 1408142 - protein, 9 aa, Homo Sapiens
FEAVGKKFS

SEQ ID NO: 1408143 - protein, 9 aa, Homo Sapiens
QTVLQQLTE

SEQ ID NO: 1408144 - protein, 9 aa, Homo Sapiens
TPSKKKLKL

SEQ ID NO: 1408145 - protein, 9 aa, Homo Sapiens
DRTLCCFVP

SEQ ID NO: 1408146 - protein, 9 aa, Homo Sapiens
FNALLLLLV

SEQ ID NO: 1408147 - protein, 9 aa, Homo Sapiens
GFRQFFKDR

SEQ ID NO: 1408148 - protein, 9 aa, Homo Sapiens
WATISLSDS

SEQ ID NO: 1408149 - protein, 9 aa, Homo Sapiens
PGRPRHINE

SEQ ID NO: 1408150 - protein, 9 aa, Homo Sapiens
EFVEKKFKE

SEQ ID NO: 1408151 - protein, 9 aa, Homo Sapiens
GQLPDTESG

SEQ ID NO: 1408152 - protein, 9 aa, Homo Sapiens
AAMQDLKMS

SEQ ID NO: 1408153 - protein, 9 aa, Homo Sapiens
LKFFFGSSA

SEQ ID NO: 1408154 - protein, 9 aa, Homo Sapiens
DMTLDAYTA

SEQ ID NO: 1408155 - protein, 9 aa, Homo Sapiens
HVNKPNTVF

SEQ ID NO: 1408156 - protein, 9 aa, Homo Sapiens
PRHINEEVE

SEQ ID NO: 1408157 - protein, 9 aa, Homo Sapiens
QFFMCTAKT

SEQ ID NO: 1408158 - protein, 9 aa, Homo Sapiens
DHMWRLPFS

SEQ ID NO: 1408159 - protein, 9 aa, Homo Sapiens
RNIIQETQM

SEQ ID NO: 1408160 - protein, 9 aa, Homo Sapiens
KKLKLAPLQ

SEQ ID NO: 1408161 - protein, 9 aa, Homo Sapiens
QAMHFPESN

SEQ ID NO: 1408162 - protein, 9 aa, Homo Sapiens
WPQGAHGES

SEQ ID NO: 1408163 - protein, 9 aa, Homo Sapiens
DLKQSLNLF

SEQ ID NO: 1408164 - protein, 9 aa, Homo Sapiens
VSYTTSLYF

SEQ ID NO: 1408165 - protein, 9 aa, Homo Sapiens
DFKKLQKEL

SEQ ID NO: 1408166 - protein, 9 aa, Homo Sapiens
SKKKLKLAP

SEQ ID NO: 1408167 - protein, 9 aa, Homo Sapiens
ETAIQTVLQ

SEQ ID NO: 1408168 - protein, 9 aa, Homo Sapiens
SLKFFFGSS

SEQ ID NO: 1408169 - protein, 9 aa, Homo Sapiens
AIQKQSETL

SEQ ID NO: 1408170 - protein, 9 aa, Homo Sapiens
GEARARQLS

SEQ ID NO: 1408171 - protein, 9 aa, Homo Sapiens
NCVTLCMFR

SEQ ID NO: 1408172 - protein, 9 aa, Homo Sapiens
TARRHPWPT

SEQ ID NO: 1408173 - protein, 9 aa, Homo Sapiens
LLLSAIVSI

SEQ ID NO: 1408174 - protein, 9 aa, Homo Sapiens
QVDMTLDAY

SEQ ID NO: 1408175 - protein, 9 aa, Homo Sapiens
DKKKKNMHR

SEQ ID NO: 1408176 - protein, 9 aa, Homo Sapiens
LQKELWQIH

SEQ ID NO: 1408177 - protein, 9 aa, Homo Sapiens
GHILAGTVK

SEQ ID NO: 1408178 - protein, 9 aa, Homo Sapiens
EAVGKKFSN

SEQ ID NO: 1408179 - protein, 9 aa, Homo Sapiens
PGPGGGGGA

SEQ ID NO: 1408180 - protein, 9 aa, Homo Sapiens
EPSCDRLID

SEQ ID NO: 1408181 - protein, 9 aa, Homo Sapiens
MQIECQKML

SEQ ID NO: 1408182 - protein, 9 aa, Homo Sapiens
LPDTESGYT

SEQ ID NO: 1408183 - protein, 9 aa, Homo Sapiens
FPMPDDFPN

SEQ ID NO: 1408184 - protein, 9 aa, Homo Sapiens
KNPDNKEFV

SEQ ID NO: 1408185 - protein, 9 aa, Homo Sapiens
LGTTLDPHY

SEQ ID NO: 1408186 - protein, 9 aa, Homo Sapiens
LGQESCCSP

SEQ ID NO: 1408187 - protein, 9 aa, Homo Sapiens
AARGGGGAG

SEQ ID NO: 1408188 - protein, 9 aa, Homo Sapiens
SSHSSLSSL

SEQ ID NO: 1408189 - protein, 9 aa, Homo Sapiens
PVGLTRVLE

SEQ ID NO: 1408190 - protein, 9 aa, Homo Sapiens
TGDDNTNGK

SEQ ID NO: 1408191 - protein, 9 aa, Homo Sapiens
PRMREIQIS

SEQ ID NO: 1408192 - protein, 9 aa, Homo Sapiens
FINRSFHIS

SEQ ID NO: 1408193 - protein, 9 aa, Homo Sapiens
ARTGESGAG

SEQ ID NO: 1408194 - protein, 9 aa, Homo Sapiens
SILQEKKNN

SEQ ID NO: 1408195 - protein, 9 aa, Homo Sapiens
GTPPPPPPP

SEQ ID NO: 1408196 - protein, 9 aa, Homo Sapiens
IREHLWNSK

SEQ ID NO: 1408197 - protein, 9 aa, Homo Sapiens
DLTIQIADE

SEQ ID NO: 1408198 - protein, 9 aa, Homo Sapiens
RRSSDSKIH

SEQ ID NO: 1408199 - protein, 9 aa, Homo Sapiens
SIMLGSGMP

SEQ ID NO: 1408200 - protein, 9 aa, Homo Sapiens
VAFGFRQFF

SEQ ID NO: 1408201 - protein, 9 aa, Homo Sapiens
SDFKKLQKE

SEQ ID NO: 1408202 - protein, 9 aa, Homo Sapiens
IENEDIIKD

SEQ ID NO: 1408203 - protein, 9 aa, Homo Sapiens
PPPVPPLGL

SEQ ID NO: 1408204 - protein, 9 aa, Homo Sapiens
KKKKNMHRA

SEQ ID NO: 1408205 - protein, 9 aa, Homo Sapiens
VVSKDTYRD

SEQ ID NO: 1408206 - protein, 9 aa, Homo Sapiens
FSIMLGSGM

SEQ ID NO: 1408207 - protein, 9 aa, Homo Sapiens
KKNNSDHMW

SEQ ID NO: 1408208 - protein, 9 aa, Homo Sapiens
WRLPFSCTL

SEQ ID NO: 1408209 - protein, 9 aa, Homo Sapiens
SSLKSQVIF

SEQ ID NO: 1408210 - protein, 9 aa, Homo Sapiens
SWIIPRGWG

SEQ ID NO: 1408211 - protein, 9 aa, Homo Sapiens
LCFKDFAKR

SEQ ID NO: 1408212 - protein, 9 aa, Homo Sapiens
AIQTVLQQL

SEQ ID NO: 1408213 - protein, 9 aa, Homo Sapiens
KAIQKQSET

SEQ ID NO: 1408214 - protein, 9 aa, Homo Sapiens
ARARQLSPQ

SEQ ID NO: 1408215 - protein, 9 aa, Homo Sapiens
RIAERSVCG

SEQ ID NO: 1408216 - protein, 9 aa, Homo Sapiens
HAVTGLQCS

SEQ ID NO: 1408217 - protein, 9 aa, Homo Sapiens
LASLSSHSS

SEQ ID NO: 1408218 - protein, 9 aa, Homo Sapiens
RDDGRWATI

SEQ ID NO: 1408219 - protein, 9 aa, Homo Sapiens
SSALTAGLR

SEQ ID NO: 1408220 - protein, 9 aa, Homo Sapiens
VNLRKLLPG

SEQ ID NO: 1408221 - protein, 9 aa, Homo Sapiens
ESSLASSQA

SEQ ID NO: 1408222 - protein, 9 aa, Homo Sapiens
HGESSLASS

SEQ ID NO: 1408223 - protein, 9 aa, Homo Sapiens
QETQISNHL

SEQ ID NO: 1408224 - protein, 9 aa, Homo Sapiens
PPLLLLALG

SEQ ID NO: 1408225 - protein, 9 aa, Homo Sapiens
IQTVLQQLT

SEQ ID NO: 1408226 - protein, 9 aa, Homo Sapiens
TGLRNLGNA

SEQ ID NO: 1408227 - protein, 9 aa, Homo Sapiens
GFDKGDAVL

SEQ ID NO: 1408228 - protein, 9 aa, Homo Sapiens
ERSVCGRCH

SEQ ID NO: 1408229 - protein, 9 aa, Homo Sapiens
AKRCEDALR

SEQ ID NO: 1408230 - protein, 9 aa, Homo Sapiens
MTLDAYTAN

SEQ ID NO: 1408231 - protein, 9 aa, Homo Sapiens
RLPLPPLLL

SEQ ID NO: 1408232 - protein, 9 aa, Homo Sapiens
SKALLERFI

SEQ ID NO: 1408233 - protein, 9 aa, Homo Sapiens
ESILQEKKN

SEQ ID NO: 1408234 - protein, 9 aa, Homo Sapiens
TDNCFSSSS

SEQ ID NO: 1408235 - protein, 9 aa, Homo Sapiens
AQPKTVILF

SEQ ID NO: 1408236 - protein, 9 aa, Homo Sapiens
LPPLLLLAL

SEQ ID NO: 1408237 - protein, 9 aa, Homo Sapiens
VNNHEFSWI

SEQ ID NO: 1408238 - protein, 9 aa, Homo Sapiens
FANPLPSMK

SEQ ID NO: 1408239 - protein, 9 aa, Homo Sapiens
QTAGKIIRE

SEQ ID NO: 1408240 - protein, 9 aa, Homo Sapiens
RDLTIQIAD

SEQ ID NO: 1408241 - protein, 9 aa, Homo Sapiens
HMLVNIGCK

SEQ ID NO: 1408242 - protein, 9 aa, Homo Sapiens
STQAMHFPE

SEQ ID NO: 1408243 - protein, 9 aa, Homo Sapiens
IFLQKRASI

SEQ ID NO: 1408244 - protein, 9 aa, Homo Sapiens
EEEEEKGNQ

SEQ ID NO: 1408245 - protein, 9 aa, Homo Sapiens
NPSETSSTT

SEQ ID NO: 1408246 - protein, 9 aa, Homo Sapiens
KIIREHLWN

SEQ ID NO: 1408247 - protein, 9 aa, Homo Sapiens
CPPSHAARE

SEQ ID NO: 1408248 - protein, 9 aa, Homo Sapiens
QNGIESSSD

SEQ ID NO: 1408249 - protein, 9 aa, Homo Sapiens
SAGEGTGLA

SEQ ID NO: 1408250 - protein, 9 aa, Homo Sapiens
DFPMPDDFP

SEQ ID NO: 1408251 - protein, 9 aa, Homo Sapiens
ILLNCVTLC

SEQ ID NO: 1408252 - protein, 9 aa, Homo Sapiens
WSQDTGDDN

SEQ ID NO: 1408253 - protein, 9 aa, Homo Sapiens
CCFVPENMT

SEQ ID NO: 1408254 - protein, 9 aa, Homo Sapiens
NGSQFFMCT

SEQ ID NO: 1408255 - protein, 9 aa, Homo Sapiens
SSRQSSIVK

SEQ ID NO: 1408256 - protein, 9 aa, Homo Sapiens
GWDPNVNLR

SEQ ID NO: 1408257 - protein, 9 aa, Homo Sapiens
GTVKDIVTR

SEQ ID NO: 1408258 - protein, 9 aa, Homo Sapiens
TEYKIEWQK

SEQ ID NO: 1408259 - protein, 9 aa, Homo Sapiens
SKDTYRDLQ

SEQ ID NO: 1408260 - protein, 9 aa, Homo Sapiens
YHVNKPNTV

SEQ ID NO: 1408261 - protein, 9 aa, Homo Sapiens
GTTLDPHYV

SEQ ID NO: 1408262 - protein, 9 aa, Homo Sapiens
AGKIIREHL

SEQ ID NO: 1408263 - protein, 9 aa, Homo Sapiens
LKLILVMLE

SEQ ID NO: 1408264 - protein, 9 aa, Homo Sapiens
SSDSKIHKD

SEQ ID NO: 1408265 - protein, 9 aa, Homo Sapiens
DNTNGKDWG

SEQ ID NO: 1408266 - protein, 9 aa, Homo Sapiens
DDEPGRPRH

SEQ ID NO: 1408267 - protein, 9 aa, Homo Sapiens
RGGGGAGEQ

SEQ ID NO: 1408268 - protein, 9 aa, Homo Sapiens
LVAFGFRQF

SEQ ID NO: 1408269 - protein, 9 aa, Homo Sapiens
VSKDTYRDL

SEQ ID NO: 1408270 - protein, 9 aa, Homo Sapiens
RIARSSRQS

SEQ ID NO: 1408271 - protein, 9 aa, Homo Sapiens
CSKALLERF

SEQ ID NO: 1408272 - protein, 9 aa, Homo Sapiens
IEWQKGAPR

SEQ ID NO: 1408273 - protein, 9 aa, Homo Sapiens
TAGLRRLVT

SEQ ID NO: 1408274 - protein, 9 aa, Homo Sapiens
SQVIFLQKR

SEQ ID NO: 1408275 - protein, 9 aa, Homo Sapiens
VTGLQCSPT

SEQ ID NO: 1408276 - protein, 9 aa, Homo Sapiens
TMKFPPKIP

SEQ ID NO: 1408277 - protein, 9 aa, Homo Sapiens
APLQVTTTL

SEQ ID NO: 1408278 - protein, 9 aa, Homo Sapiens
IFQNGIESS

SEQ ID NO: 1408279 - protein, 9 aa, Homo Sapiens
EDEETAIQT

SEQ ID NO: 1408280 - protein, 9 aa, Homo Sapiens
TAGKIIREH

SEQ ID NO: 1408281 - protein, 9 aa, Homo Sapiens
SCGEARARQ

SEQ ID NO: 1408282 - protein, 9 aa, Homo Sapiens
ASLSSHSSL

SEQ ID NO: 1408283 - protein, 9 aa, Homo Sapiens
TTLKLILVM

SEQ ID NO: 1408284 - protein, 9 aa, Homo Sapiens
PTDNCFSSS

SEQ ID NO: 1408285 - protein, 9 aa, Homo Sapiens
SGAGPGPAC

SEQ ID NO: 1408286 - protein, 9 aa, Homo Sapiens
HLDTPEERE

SEQ ID NO: 1408287 - protein, 9 aa, Homo Sapiens
QDLKMSVAS

SEQ ID NO: 1408288 - protein, 9 aa, Homo Sapiens
EGETEYKIE

SEQ ID NO: 1408289 - protein, 9 aa, Homo Sapiens
PQGAHGESS

SEQ ID NO: 1408290 - protein, 9 aa, Homo Sapiens
QCSPTRPAV

SEQ ID NO: 1408291 - protein, 9 aa, Homo Sapiens
FRQFFKDRW

SEQ ID NO: 1408292 - protein, 9 aa, Homo Sapiens
CAQPKTVIL

SEQ ID NO: 1408293 - protein, 9 aa, Homo Sapiens
PLPPLLLLA

SEQ ID NO: 1408294 - protein, 9 aa, Homo Sapiens
DNCFSSSSD

SEQ ID NO: 1408295 - protein, 9 aa, Homo Sapiens
NDNERLSKV

SEQ ID NO: 1408296 - protein, 9 aa, Homo Sapiens
KFSNVRINL

SEQ ID NO: 1408297 - protein, 9 aa, Homo Sapiens
KNMHRASAP

SEQ ID NO: 1408298 - protein, 9 aa, Homo Sapiens
SKIHKDSLG

SEQ ID NO: 1408299 - protein, 9 aa, Homo Sapiens
NALLLLLVA

SEQ ID NO: 1408300 - protein, 9 aa, Homo Sapiens
TVIERTFHL

SEQ ID NO: 1408301 - protein, 9 aa, Homo Sapiens
MCTAKTEWL

SEQ ID NO: 1408302 - protein, 9 aa, Homo Sapiens
LLSAIVSIS

SEQ ID NO: 1408303 - protein, 9 aa, Homo Sapiens
AAPPVGLTR

SEQ ID NO: 1408304 - protein, 9 aa, Homo Sapiens
CFKDFAKRC

SEQ ID NO: 1408305 - protein, 9 aa, Homo Sapiens
SQHRIARSS

SEQ ID NO: 1408306 - protein, 9 aa, Homo Sapiens
KRQEVLEMQ

SEQ ID NO: 1408307 - protein, 9 aa, Homo Sapiens
PPVGLTRVL

SEQ ID NO: 1408308 - protein, 9 aa, Homo Sapiens
IPDNDNERL

SEQ ID NO: 1408309 - protein, 9 aa, Homo Sapiens
LKDIACSKA

SEQ ID NO: 1408310 - protein, 9 aa, Homo Sapiens
NSKKLTMKF

SEQ ID NO: 1408311 - protein, 9 aa, Homo Sapiens
GKKFSNVRI

SEQ ID NO: 1408312 - protein, 9 aa, Homo Sapiens
RCRSRLFPR

SEQ ID NO: 1408313 - protein, 9 aa, Homo Sapiens
RTLCCFVPE

SEQ ID NO: 1408314 - protein, 9 aa, Homo Sapiens
EETAIQTVL

SEQ ID NO: 1408315 - protein, 9 aa, Homo Sapiens
PLPSMKITQ

SEQ ID NO: 1408316 - protein, 9 aa, Homo Sapiens
KLTMKFPPK

SEQ ID NO: 1408317 - protein, 9 aa, Homo Sapiens
CFSDFPMPD

SEQ ID NO: 1408318 - protein, 9 aa, Homo Sapiens
SLSSHSSLS

SEQ ID NO: 1408319 - protein, 9 aa, Homo Sapiens
SQQQQQQGL

SEQ ID NO: 1408320 - protein, 9 aa, Homo Sapiens
ITTAEISAG

SEQ ID NO: 1408321 - protein, 9 aa, Homo Sapiens
IERTFHLDT

SEQ ID NO: 1408322 - protein, 9 aa, Homo Sapiens
VSVSTDTIK

SEQ ID NO: 1408323 - protein, 9 aa, Homo Sapiens
IVVSKDTYR

SEQ ID NO: 1408324 - protein, 9 aa, Homo Sapiens
ERTFHLDTP

SEQ ID NO: 1408325 - protein, 9 aa, Homo Sapiens
TAQTAGKII

SEQ ID NO: 1408326 - protein, 9 aa, Homo Sapiens
AFARCPPSH

SEQ ID NO: 1408327 - protein, 9 aa, Homo Sapiens
GSTQAMHFP

SEQ ID NO: 1408328 - protein, 9 aa, Homo Sapiens
MEVTFYLGE

SEQ ID NO: 1408329 - protein, 9 aa, Homo Sapiens
SAIVSISAL

SEQ ID NO: 1408330 - protein, 9 aa, Homo Sapiens
VLLLSAIVS

SEQ ID NO: 1408331 - protein, 9 aa, Homo Sapiens
RSCGEARAR

SEQ ID NO: 1408332 - protein, 9 aa, Homo Sapiens
ESARGVILF

SEQ ID NO: 1408333 - protein, 9 aa, Homo Sapiens
QVTIPDNDN

SEQ ID NO: 1408334 - protein, 9 aa, Homo Sapiens
ARSSRQSSI

SEQ ID NO: 1408335 - protein, 9 aa, Homo Sapiens
KLKLAPLQV

SEQ ID NO: 1408336 - protein, 9 aa, Homo Sapiens
VDKKKKNMH

SEQ ID NO: 1408337 - protein, 9 aa, Homo Sapiens
RTGESGAGP

SEQ ID NO: 1408338 - protein, 9 aa, Homo Sapiens
LFINRSFHI

SEQ ID NO: 1408339 - protein, 9 aa, Homo Sapiens
QKELWQIHK

SEQ ID NO: 1408340 - protein, 9 aa, Homo Sapiens
LLSLKFFFG

SEQ ID NO: 1408341 - protein, 9 aa, Homo Sapiens
AVSVSTDTI

SEQ ID NO: 1408342 - protein, 9 aa, Homo Sapiens
FGFRQFFKD

SEQ ID NO: 1408343 - protein, 9 aa, Homo Sapiens
GLQCSPTRP

SEQ ID NO: 1408344 - protein, 9 aa, Homo Sapiens
EYKIEWQKG

SEQ ID NO: 1408345 - protein, 9 aa, Homo Sapiens
SHSSLSSLS

SEQ ID NO: 1408346 - protein, 9 aa, Homo Sapiens
NTVFKLKQG

SEQ ID NO: 1408347 - protein, 9 aa, Homo Sapiens
NPDNKEFVE

SEQ ID NO: 1408348 - protein, 9 aa, Homo Sapiens
NNHEFSWII

SEQ ID NO: 1408349 - protein, 9 aa, Homo Sapiens
LILVMLEIV

SEQ ID NO: 1408350 - protein, 9 aa, Homo Sapiens
EKQEVHMRE

SEQ ID NO: 1408351 - protein, 9 aa, Homo Sapiens
PSCDRLIDP

SEQ ID NO: 1408352 - protein, 9 aa, Homo Sapiens
RMREIQISP

SEQ ID NO: 1408353 - protein, 9 aa, Homo Sapiens
PLNSSLLPE

SEQ ID NO: 1408354 - protein, 9 aa, Homo Sapiens
SSVIYNIHT

SEQ ID NO: 1408355 - protein, 9 aa, Homo Sapiens
PTLKYFKKG

SEQ ID NO: 1408356 - protein, 9 aa, Homo Sapiens
VTTTLKLIL

SEQ ID NO: 1408357 - protein, 9 aa, Homo Sapiens
SRLPLPPLL

SEQ ID NO: 1408358 - protein, 9 aa, Homo Sapiens
ALLLLLVAF

SEQ ID NO: 1408359 - protein, 9 aa, Homo Sapiens
FQNGIESSS

SEQ ID NO: 1408360 - protein, 9 aa, Homo Sapiens
WWPALSRTA

SEQ ID NO: 1408361 - protein, 9 aa, Homo Sapiens
LAPLQVTTT

SEQ ID NO: 1408362 - protein, 9 aa, Homo Sapiens
EFSWIIPRG

SEQ ID NO: 1408363 - protein, 9 aa, Homo Sapiens
AEISAGEGT

SEQ ID NO: 1408364 - protein, 9 aa, Homo Sapiens
LLNCVTLCM

SEQ ID NO: 1408365 - protein, 9 aa, Homo Sapiens
GLSLGTTLD

SEQ ID NO: 1408366 - protein, 9 aa, Homo Sapiens
TAEISAGEG

SEQ ID NO: 1408367 - protein, 9 aa, Homo Sapiens
ALKDIACSK

SEQ ID NO: 1408368 - protein, 9 aa, Homo Sapiens
LNLFMAVYK

SEQ ID NO: 1408369 - protein, 9 aa, Homo Sapiens
LRNLGNACY

SEQ ID NO: 1408370 - protein, 9 aa, Homo Sapiens
VPMADKPSN

SEQ ID NO: 1408371 - protein, 9 aa, Homo Sapiens
IQETQMAKE

SEQ ID NO: 1408372 - protein, 9 aa, Homo Sapiens
TLDAYTANN

SEQ ID NO: 1408373 - protein, 9 aa, Homo Sapiens
YGHILAGTV

SEQ ID NO: 1408374 - protein, 9 aa, Homo Sapiens
ENEDIIKDC

SEQ ID NO: 1408375 - protein, 9 aa, Homo Sapiens
MKITQVTWQ

SEQ ID NO: 1408376 - protein, 9 aa, Homo Sapiens
TIKYVSAES

SEQ ID NO: 1408377 - protein, 9 aa, Homo Sapiens
ACYMNSILQ

SEQ ID NO: 1408378 - protein, 9 aa, Homo Sapiens
TLCCFVPEN

SEQ ID NO: 1408379 - protein, 9 aa, Homo Sapiens
SCKKVTICM

SEQ ID NO: 1408380 - protein, 9 aa, Homo Sapiens
DRGRIAERS

SEQ ID NO: 1408381 - protein, 9 aa, Homo Sapiens
NTNGSQFFM

SEQ ID NO: 1408382 - protein, 9 aa, Homo Sapiens
PVPPLGLQR

SEQ ID NO: 1408383 - protein, 9 aa, Homo Sapiens
SVASTEEET

SEQ ID NO: 1408384 - protein, 9 aa, Homo Sapiens
DMEVTFYLG

SEQ ID NO: 1408385 - protein, 9 aa, Homo Sapiens
KKLQKELWQ

SEQ ID NO: 1408386 - protein, 9 aa, Homo Sapiens
HLGLALDVD

SEQ ID NO: 1408387 - protein, 9 aa, Homo Sapiens
FHLDTPEER

SEQ ID NO: 1408388 - protein, 9 aa, Homo Sapiens
CNPSETSST

SEQ ID NO: 1408389 - protein, 9 aa, Homo Sapiens
DDFPNFLHN

SEQ ID NO: 1408390 - protein, 9 aa, Homo Sapiens
ADDEPGRPR

SEQ ID NO: 1408391 - protein, 9 aa, Homo Sapiens
DTIKYVSAE

SEQ ID NO: 1408392 - protein, 9 aa, Homo Sapiens
RPRHINEEV

SEQ ID NO: 1408393 - protein, 9 aa, Homo Sapiens
ISAGEGTGL

SEQ ID NO: 1408394 - protein, 9 aa, Homo Sapiens
AMQDLKMSV

SEQ ID NO: 1408395 - protein, 9 aa, Homo Sapiens
SNTVNFRKL

SEQ ID NO: 1408396 - protein, 9 aa, Homo Sapiens
ILRNIIQET

SEQ ID NO: 1408397 - protein, 9 aa, Homo Sapiens
ASENGDTPR

SEQ ID NO: 1408398 - protein, 9 aa, Homo Sapiens
AVGKKFSNV

SEQ ID NO: 1408399 - protein, 9 aa, Homo Sapiens
KSQVIFLQK

SEQ ID NO: 1408400 - protein, 9 aa, Homo Sapiens
DAYTANNFL

SEQ ID NO: 1408401 - protein, 9 aa, Homo Sapiens
DQGIFQNGI

SEQ ID NO: 1408402 - protein, 9 aa, Homo Sapiens
DLKMSVAST

SEQ ID NO: 1408403 - protein, 9 aa, Homo Sapiens
GYHVNKPNT

SEQ ID NO: 1408404 - protein, 9 aa, Homo Sapiens
HVGLSLGTT

SEQ ID NO: 1408405 - protein, 9 aa, Homo Sapiens
PPPPVPPLG

SEQ ID NO: 1408406 - protein, 9 aa, Homo Sapiens
AERSVCGRC

SEQ ID NO: 1408407 - protein, 9 aa, Homo Sapiens
DNKEFVEKK

SEQ ID NO: 1408408 - protein, 9 aa, Homo Sapiens
VGLTRVLEE

SEQ ID NO: 1408409 - protein, 9 aa, Homo Sapiens
AGLRRLVTV

SEQ ID NO: 1408410 - protein, 9 aa, Homo Sapiens
TLCMFRPCE

SEQ ID NO: 1408411 - protein, 9 aa, Homo Sapiens
TAIQTVLQQ

SEQ ID NO: 1408412 - protein, 9 aa, Homo Sapiens
GIVVSKDTY

SEQ ID NO: 1408413 - protein, 9 aa, Homo Sapiens
TSLYFLLFC

SEQ ID NO: 1408414 - protein, 9 aa, Homo Sapiens
KQSETLQKN

SEQ ID NO: 1408415 - protein, 9 aa, Homo Sapiens
MLTDEIIKA

SEQ ID NO: 1408416 - protein, 9 aa, Homo Sapiens
KKKTISYAG

SEQ ID NO: 1408417 - protein, 9 aa, Homo Sapiens
ARGVILFPD

SEQ ID NO: 1408418 - protein, 9 aa, Homo Sapiens
TKENSKKLT

SEQ ID NO: 1408419 - protein, 9 aa, Homo Sapiens
NVNLRKLLP

SEQ ID NO: 1408420 - protein, 9 aa, Homo Sapiens
GLALDVDRM

SEQ ID NO: 1408421 - protein, 9 aa, Homo Sapiens
LYFLLFCGP

SEQ ID NO: 1408422 - protein, 9 aa, Homo Sapiens
MQESQETQI

SEQ ID NO: 1408423 - protein, 9 aa, Homo Sapiens
NCFSSSSDL

SEQ ID NO: 1408424 - protein, 9 aa, Homo Sapiens
SDGIVVSKD

SEQ ID NO: 1408425 - protein, 9 aa, Homo Sapiens
IQVTIPDND

SEQ ID NO: 1408426 - protein, 9 aa, Homo Sapiens
TVLQQLTEE

SEQ ID NO: 1408427 - protein, 9 aa, Homo Sapiens
RVRDLTIQI

SEQ ID NO: 1408428 - protein, 9 aa, Homo Sapiens
CTDQVIVQC

SEQ ID NO: 1408429 - protein, 9 aa, Homo Sapiens
RSFHISADR

SEQ ID NO: 1408430 - protein, 9 aa, Homo Sapiens
QKQSETLQK

SEQ ID NO: 1408431 - protein, 9 aa, Homo Sapiens
TTTLKLILV

SEQ ID NO: 1408432 - protein, 9 aa, Homo Sapiens
TVKDIVTRY

SEQ ID NO: 1408433 - protein, 9 aa, Homo Sapiens
ASQHRIARS

SEQ ID NO: 1408434 - protein, 9 aa, Homo Sapiens
IARSSRQSS

SEQ ID NO: 1408435 - protein, 9 aa, Homo Sapiens
DTESGYTEQ

SEQ ID NO: 1408436 - protein, 9 aa, Homo Sapiens
TLKYFKKGE

SEQ ID NO: 1408437 - protein, 9 aa, Homo Sapiens
ESGYTEQLF

SEQ ID NO: 1408438 - protein, 9 aa, Homo Sapiens
WDPNVNLRK

SEQ ID NO: 1408439 - protein, 9 aa, Homo Sapiens
LKYFKKGEK

SEQ ID NO: 1408440 - protein, 9 aa, Homo Sapiens
NHEFSWIIP

SEQ ID NO: 1408441 - protein, 9 aa, Homo Sapiens
SLGTTLDPH

SEQ ID NO: 1408442 - protein, 9 aa, Homo Sapiens
TVFKLKQGK

SEQ ID NO: 1408443 - protein, 9 aa, Homo Sapiens
EVLEMQIEC

SEQ ID NO: 1408444 - protein, 9 aa, Homo Sapiens
TICMTIRKN

SEQ ID NO: 1408445 - protein, 9 aa, Homo Sapiens
QSLNLFMAV

SEQ ID NO: 1408446 - protein, 9 aa, Homo Sapiens
FSWIIPRGW

SEQ ID NO: 1408447 - protein, 9 aa, Homo Sapiens
KGEKYAVPV

SEQ ID NO: 1408448 - protein, 9 aa, Homo Sapiens
NMHRASAPE

SEQ ID NO: 1408449 - protein, 9 aa, Homo Sapiens
SDSKIHKDS

SEQ ID NO: 1408450 - protein, 9 aa, Homo Sapiens
TVILFKVLL

SEQ ID NO: 1408451 - protein, 9 aa, Homo Sapiens
HYSYTASSV

SEQ ID NO: 1408452 - protein, 9 aa, Homo Sapiens
TDQVIVQCC

SEQ ID NO: 1408453 - protein, 9 aa, Homo Sapiens
LFMAVYKLN

SEQ ID NO: 1408454 - protein, 9 aa, Homo Sapiens
HRIARSSRQ

SEQ ID NO: 1408455 - protein, 9 aa, Homo Sapiens
LTMKFPPKI

SEQ ID NO: 1408456 - protein, 9 aa, Homo Sapiens
RLPFSCTLK

SEQ ID NO: 1408457 - protein, 9 aa, Homo Sapiens
KENSKKLTM

SEQ ID NO: 1408458 - protein, 9 aa, Homo Sapiens
YRNKDNEKY

SEQ ID NO: 1408459 - protein, 9 aa, Homo Sapiens
NKDNEKYPN

SEQ ID NO: 1408460 - protein, 9 aa, Homo Sapiens
RDMLTDEII

SEQ ID NO: 1408461 - protein, 9 aa, Homo Sapiens
LSRTARRHP

SEQ ID NO: 1408462 - protein, 9 aa, Homo Sapiens
MLVNIGCKK

SEQ ID NO: 1408463 - protein, 9 aa, Homo Sapiens
PSMKITQVT

SEQ ID NO: 1408464 - protein, 9 aa, Homo Sapiens
ENSKKLTMK

SEQ ID NO: 1408465 - protein, 9 aa, Homo Sapiens
LLPEKQEVH

SEQ ID NO: 1408466 - protein, 9 aa, Homo Sapiens
PDQGWDPNV

SEQ ID NO: 1408467 - protein, 9 aa, Homo Sapiens
HIRDDGRWA

SEQ ID NO: 1408468 - protein, 9 aa, Homo Sapiens
IIFVLLLSA

SEQ ID NO: 1408469 - protein, 9 aa, Homo Sapiens
SHAVTGLQC

SEQ ID NO: 1408470 - protein, 9 aa, Homo Sapiens
TASSVIYNI

SEQ ID NO: 1408471 - protein, 9 aa, Homo Sapiens
CKKVTICMT

SEQ ID NO: 1408472 - protein, 9 aa, Homo Sapiens
DPNVNLRKL

SEQ ID NO: 1408473 - protein, 9 aa, Homo Sapiens
GSQFFMCTA

SEQ ID NO: 1408474 - protein, 9 aa, Homo Sapiens
ICNPSETSS

SEQ ID NO: 1408475 - protein, 9 aa, Homo Sapiens
ENGDTPRMR

SEQ ID NO: 1408476 - protein, 9 aa, Homo Sapiens
KKLTMKFPP

SEQ ID NO: 1408477 - protein, 9 aa, Homo Sapiens
FVEKKFKEV

SEQ ID NO: 1408478 - protein, 9 aa, Homo Sapiens
LFSIMLGSG

SEQ ID NO: 1408479 - protein, 9 aa, Homo Sapiens
FKKGEKYAV

SEQ ID NO: 1408480 - protein, 9 aa, Homo Sapiens
SSLLPEKQE

SEQ ID NO: 1408481 - protein, 9 aa, Homo Sapiens
QGIFQNGIE

SEQ ID NO: 1408482 - protein, 9 aa, Homo Sapiens
GESGAGPGP

SEQ ID NO: 1408483 - protein, 9 aa, Homo Sapiens
SENGDTPRM

SEQ ID NO: 1408484 - protein, 9 aa, Homo Sapiens
CDRLIDPHR

SEQ ID NO: 1408485 - protein, 9 aa, Homo Sapiens
RTFHLDTPE

SEQ ID NO: 1408486 - protein, 9 aa, Homo Sapiens
FKKLQKELW

SEQ ID NO: 1408487 - protein, 9 aa, Homo Sapiens
DTPRMREIQ

SEQ ID NO: 1408488 - protein, 9 aa, Homo Sapiens
DAAPPVGLT

SEQ ID NO: 1408489 - protein, 9 aa, Homo Sapiens
ARGGGGAGE

SEQ ID NO: 1408490 - protein, 9 aa, Homo Sapiens
SQFFMCTAK

SEQ ID NO: 1408491 - protein, 9 aa, Homo Sapiens
EKGNQETAE

SEQ ID NO: 1408492 - protein, 9 aa, Homo Sapiens
NACYMNSIL

SEQ ID NO: 1408493 - protein, 9 aa, Homo Sapiens
IIKDCVRIH

SEQ ID NO: 1408494 - protein, 9 aa, Homo Sapiens
QDTGDDNTN

SEQ ID NO: 1408495 - protein, 9 aa, Homo Sapiens
PGSTQAMHF

SEQ ID NO: 1408496 - protein, 9 aa, Homo Sapiens
MQDLKMSVA

SEQ ID NO: 1408497 - protein, 9 aa, Homo Sapiens
FFMCTAKTE

SEQ ID NO: 1408498 - protein, 9 aa, Homo Sapiens
ARQLSPQLG

SEQ ID NO: 1408499 - protein, 9 aa, Homo Sapiens
HSSLSSLSP

SEQ ID NO: 1408500 - protein, 9 aa, Homo Sapiens
RQEVLEMQI

SEQ ID NO: 1408501 - protein, 9 aa, Homo Sapiens
VDRTLCCFV

SEQ ID NO: 1408502 - protein, 9 aa, Homo Sapiens
KNIICNPSE

SEQ ID NO: 1408503 - protein, 9 aa, Homo Sapiens
EDIIKDCVR

SEQ ID NO: 1408504 - protein, 9 aa, Homo Sapiens
GKIIREHLW

SEQ ID NO: 1408505 - protein, 9 aa, Homo Sapiens
AREQQQQQP

SEQ ID NO: 1408506 - protein, 9 aa, Homo Sapiens
DTGDDNTNG

SEQ ID NO: 1408507 - protein, 9 aa, Homo Sapiens
SWARTGESG

SEQ ID NO: 1408508 - protein, 9 aa, Homo Sapiens
SMKAIQKQS

SEQ ID NO: 1408509 - protein, 9 aa, Homo Sapiens
CMFRPCEDI

SEQ ID NO: 1408510 - protein, 9 aa, Homo Sapiens
GRPRHINEE

SEQ ID NO: 1408511 - protein, 9 aa, Homo Sapiens
EIIKAAAKE

SEQ ID NO: 1408512 - protein, 9 aa, Homo Sapiens
LLKDCRCRS

SEQ ID NO: 1408513 - protein, 9 aa, Homo Sapiens
EKKNNSDHM

SEQ ID NO: 1408514 - protein, 9 aa, Homo Sapiens
EITEVNLPK

SEQ ID NO: 1408515 - protein, 9 aa, Homo Sapiens
KDFAKRCED

SEQ ID NO: 1408516 - protein, 9 aa, Homo Sapiens
KVDKKKKNM

SEQ ID NO: 1408517 - protein, 9 aa, Homo Sapiens
TLDPHYVLL

SEQ ID NO: 1408518 - protein, 9 aa, Homo Sapiens
EMQIECQKM

SEQ ID NO: 1408519 - protein, 9 aa, Homo Sapiens
EEITEVNLP

SEQ ID NO: 1408520 - protein, 9 aa, Homo Sapiens
GNACYMNSI

SEQ ID NO: 1408521 - protein, 9 aa, Homo Sapiens
MKAIQKQSE

SEQ ID NO: 1408522 - protein, 9 aa, Homo Sapiens
KKFSNVRIN

SEQ ID NO: 1408523 - protein, 9 aa, Homo Sapiens
NEKYPNVKK

SEQ ID NO: 1408524 - protein, 9 aa, Homo Sapiens
SLLPEKQEV

SEQ ID NO: 1408525 - protein, 9 aa, Homo Sapiens
VKDIVTRYA

SEQ ID NO: 1408526 - protein, 9 aa, Homo Sapiens
YTTSLYFLL

SEQ ID NO: 1408527 - protein, 9 aa, Homo Sapiens
DQVIVQCCL

SEQ ID NO: 1408528 - protein, 9 aa, Homo Sapiens
PMADKPSNT

SEQ ID NO: 1408529 - protein, 9 aa, Homo Sapiens
LEDQGIFQN

SEQ ID NO: 1408530 - protein, 9 aa, Homo Sapiens
SYTASSVIY

SEQ ID NO: 1408531 - protein, 9 aa, Homo Sapiens
KEEEEEEKG

SEQ ID NO: 1408532 - protein, 9 aa, Homo Sapiens
PDNKEFVEK

SEQ ID NO: 1408533 - protein, 9 aa, Homo Sapiens
PNVNLRKLL

SEQ ID NO: 1408534 - protein, 9 aa, Homo Sapiens
CMTIRKNEC

SEQ ID NO: 1408535 - protein, 9 aa, Homo Sapiens
EKYPNVKKA

SEQ ID NO: 1408536 - protein, 9 aa, Homo Sapiens
KALLERFII

SEQ ID NO: 1408537 - protein, 9 aa, Homo Sapiens
IIQVTIPDN

SEQ ID NO: 1408538 - protein, 9 aa, Homo Sapiens
AYTANNFLL

SEQ ID NO: 1408539 - protein, 9 aa, Homo Sapiens
LQCSPTRPA

SEQ ID NO: 1408540 - protein, 9 aa, Homo Sapiens
VGKKFSNVR

SEQ ID NO: 1408541 - protein, 9 aa, Homo Sapiens
NEDIIKDCV

SEQ ID NO: 1408542 - protein, 9 aa, Homo Sapiens
ESQETQISN

SEQ ID NO: 1408543 - protein, 9 aa, Homo Sapiens
FYLGEETVR

SEQ ID NO: 1408544 - protein, 9 aa, Homo Sapiens
NSDHMWRLP

SEQ ID NO: 1408545 - protein, 9 aa, Homo Sapiens
KLILVMLEI

SEQ ID NO: 1408546 - protein, 9 aa, Homo Sapiens
IQIADEVVW

SEQ ID NO: 1408547 - protein, 9 aa, Homo Sapiens
QHRIARSSR

SEQ ID NO: 1408548 - protein, 9 aa, Homo Sapiens
ETEYKIEWQ

SEQ ID NO: 1408549 - protein, 9 aa, Homo Sapiens
ESGAGPGPA

SEQ ID NO: 1408550 - protein, 9 aa, Homo Sapiens
QAARGGGGA

SEQ ID NO: 1408551 - protein, 9 aa, Homo Sapiens
LDLKQSLNL

SEQ ID NO: 1408552 - protein, 9 aa, Homo Sapiens
DMLTDEIIK

SEQ ID NO: 1408553 - protein, 9 aa, Homo Sapiens
TFHLDTPEE

SEQ ID NO: 1408554 - protein, 9 aa, Homo Sapiens
RARQLSPQL

SEQ ID NO: 1408555 - protein, 9 aa, Homo Sapiens
YLLSLKFFF

SEQ ID NO: 1408556 - protein, 9 aa, Homo Sapiens
NRSFHISAD

SEQ ID NO: 1408557 - protein, 9 aa, Homo Sapiens
TESGYTEQL

SEQ ID NO: 1408558 - protein, 9 aa, Homo Sapiens
GEPSCDRLI

SEQ ID NO: 1408559 - protein, 9 aa, Homo Sapiens
NLVEEITEV

SEQ ID NO: 1408560 - protein, 9 aa, Homo Sapiens
NGDTPRMRE

SEQ ID NO: 1408561 - protein, 9 aa, Homo Sapiens
HMWRLPFSC

SEQ ID NO: 1408562 - protein, 9 aa, Homo Sapiens
SVIYNIHTR

SEQ ID NO: 1408563 - protein, 9 aa, Homo Sapiens
IHKDSLGSK

SEQ ID NO: 1408564 - protein, 9 aa, Homo Sapiens
ALSRTARRH

SEQ ID NO: 1408565 - protein, 9 aa, Homo Sapiens
CGEARARQL

SEQ ID NO: 1408566 - protein, 9 aa, Homo Sapiens
ATKNIICNP

SEQ ID NO: 1408567 - protein, 9 aa, Homo Sapiens
FMCTAKTEW

SEQ ID NO: 1408568 - protein, 9 aa, Homo Sapiens
LSLKFFFGS

SEQ ID NO: 1408569 - protein, 9 aa, Homo Sapiens
TDEIIKAAA

SEQ ID NO: 1408570 - protein, 9 aa, Homo Sapiens
KHILGFDKG

SEQ ID NO: 1408571 - protein, 9 aa, Homo Sapiens
GNLVEEITE

SEQ ID NO: 1408572 - protein, 9 aa, Homo Sapiens
TTSLYFLLF

SEQ ID NO: 1408573 - protein, 9 aa, Homo Sapiens
KKVTICMTI

SEQ ID NO: 1408574 - protein, 9 aa, Homo Sapiens
VRDLTIQIA

SEQ ID NO: 1408575 - protein, 9 aa, Homo Sapiens
VEEITEVNL

SEQ ID NO: 1408576 - protein, 9 aa, Homo Sapiens
KDTYRDLQG

SEQ ID NO: 1408577 - protein, 9 aa, Homo Sapiens
KQSLNLFMA

SEQ ID NO: 1408578 - protein, 9 aa, Homo Sapiens
MPDDFPNFL

SEQ ID NO: 1408579 - protein, 9 aa, Homo Sapiens
SDFPMPDDF

SEQ ID NO: 1408580 - protein, 9 aa, Homo Sapiens
PEKQEVHMR

SEQ ID NO: 1408581 - protein, 9 aa, Homo Sapiens
SALTAGLRR

SEQ ID NO: 1408582 - protein, 9 aa, Homo Sapiens
EEEEKGNQE

SEQ ID NO: 1408583 - protein, 9 aa, Homo Sapiens
DDNTNGKDW

SEQ ID NO: 1408584 - protein, 9 aa, Homo Sapiens
ITEVNLPKA

SEQ ID NO: 1408585 - protein, 9 aa, Homo Sapiens
KFFFGSSAT

SEQ ID NO: 1408586 - protein, 9 aa, Homo Sapiens
RTARRHPWP

SEQ ID NO: 1408587 - protein, 9 aa, Homo Sapiens
LGNACYMNS

SEQ ID NO: 1408588 - protein, 9 aa, Homo Sapiens
FKDFAKRCE

SEQ ID NO: 1408589 - protein, 9 aa, Homo Sapiens
AVTGLQCSP

SEQ ID NO: 1408590 - protein, 9 aa, Homo Sapiens
LQEKKNNSD

SEQ ID NO: 1408591 - protein, 9 aa, Homo Sapiens
SSPGSTQAM

SEQ ID NO: 1408592 - protein, 9 aa, Homo Sapiens
LQVTTTLKL

SEQ ID NO: 1408593 - protein, 9 aa, Homo Sapiens
KDCRCRSRL

SEQ ID NO: 1408594 - protein, 9 aa, Homo Sapiens
HLPVTDTSS

SEQ ID NO: 1408595 - protein, 9 aa, Homo Sapiens
PDIENEDII

SEQ ID NO: 1408596 - protein, 9 aa, Homo Sapiens
SPGSTQAMH

SEQ ID NO: 1408597 - protein, 9 aa, Homo Sapiens
PGGGGGAGG

SEQ ID NO: 1408598 - protein, 9 aa, Homo Sapiens
SCDRLIDPH

SEQ ID NO: 1408599 - protein, 9 aa, Homo Sapiens
WARTGESGA

SEQ ID NO: 1408600 - protein, 9 aa, Homo Sapiens
GQESCCSPS

SEQ ID NO: 1408601 - protein, 9 aa, Homo Sapiens
HGRLFINRS

SEQ ID NO: 1408602 - protein, 9 aa, Homo Sapiens
KLVAFGFRQ

SEQ ID NO: 1408603 - protein, 9 aa, Homo Sapiens
MADKPSNTV

SEQ ID NO: 1408604 - protein, 9 aa, Homo Sapiens
ARCPPSHAA

SEQ ID NO: 1408605 - protein, 9 aa, Homo Sapiens
PDDFPNFLH

SEQ ID NO: 1408606 - protein, 9 aa, Homo Sapiens
RGRIAERSV

SEQ ID NO: 1408607 - protein, 9 aa, Homo Sapiens
KKKLKLAPL

SEQ ID NO: 1408608 - protein, 9 aa, Homo Sapiens
LVMLEIVTE

SEQ ID NO: 1408609 - protein, 9 aa, Homo Sapiens
LPEKQEVHM

SEQ ID NO: 1408610 - protein, 9 aa, Homo Sapiens
IKAAAKESP

SEQ ID NO: 1408611 - protein, 9 aa, Homo Sapiens
LKMSVASTE

SEQ ID NO: 1408612 - protein, 9 aa, Homo Sapiens
QPKTVILFK

SEQ ID NO: 1408613 - protein, 9 aa, Homo Sapiens
GEGTGLAGV

SEQ ID NO: 1408614 - protein, 9 aa, Homo Sapiens
TKNIICNPS

SEQ ID NO: 1408615 - protein, 9 aa, Homo Sapiens
HILAGTVKD

SEQ ID NO: 1408616 - protein, 9 aa, Homo Sapiens
LKSQVIFLQ

SEQ ID NO: 1408617 - protein, 9 aa, Homo Sapiens
CSPTRPAVF

SEQ ID NO: 1408618 - protein, 9 aa, Homo Sapiens
QGAHGESSL

SEQ ID NO: 1408619 - protein, 9 aa, Homo Sapiens
FDKGDAVLN

SEQ ID NO: 1408620 - protein, 9 aa, Homo Sapiens
SLYFLLFCG

SEQ ID NO: 1408621 - protein, 9 aa, Homo Sapiens
VNIGCKKKT

SEQ ID NO: 1408622 - protein, 9 aa, Homo Sapiens
LDAYTANNF

SEQ ID NO: 1408623 - protein, 9 aa, Homo Sapiens
RSQQQQQQG

SEQ ID NO: 1408624 - protein, 9 aa, Homo Sapiens
LPFSCTLKR

SEQ ID NO: 1408625 - protein, 9 aa, Homo Sapiens
QEVLEMQIE

SEQ ID NO: 1408626 - protein, 9 aa, Homo Sapiens
ILFKVLLTV

SEQ ID NO: 1408627 - protein, 9 aa, Homo Sapiens
TTAEISAGE

SEQ ID NO: 1408628 - protein, 9 aa, Homo Sapiens
YLGEETVRI

SEQ ID NO: 1408629 - protein, 9 aa, Homo Sapiens
QLPDTESGY

SEQ ID NO: 1408630 - protein, 9 aa, Homo Sapiens
KYPNVKKAL

SEQ ID NO: 1408631 - protein, 9 aa, Homo Sapiens
PKTVILFKV

SEQ ID NO: 1408632 - protein, 9 aa, Homo Sapiens
YSDFKKLQK

SEQ ID NO: 1408633 - protein, 9 aa, Homo Sapiens
IQKQSETLQ

SEQ ID NO: 1408634 - protein, 9 aa, Homo Sapiens
SGYTEQLFQ

SEQ ID NO: 1408635 - protein, 9 aa, Homo Sapiens
LDVDRMKKD

SEQ ID NO: 1408636 - protein, 9 aa, Homo Sapiens
DNEKYPNVK

SEQ ID NO: 1408637 - protein, 9 aa, Homo Sapiens
DNDNERLSK

SEQ ID NO: 1408638 - protein, 9 aa, Homo Sapiens
VGLSLGTTL

SEQ ID NO: 1408639 - protein, 9 aa, Homo Sapiens
VLEMQIECQ

SEQ ID NO: 1408640 - protein, 9 aa, Homo Sapiens
LSAIVSISA

SEQ ID NO: 1408641 - protein, 9 aa, Homo Sapiens
FAKRCEDAL

SEQ ID NO: 1408642 - protein, 9 aa, Homo Sapiens
SYSPRPTDN

SEQ ID NO: 1408643 - protein, 9 aa, Homo Sapiens
TLLLLLLLP

SEQ ID NO: 1408644 - protein, 9 aa, Homo Sapiens
QCCLSAKNM

SEQ ID NO: 1408645 - protein, 9 aa, Homo Sapiens
CKKKTISYA

SEQ ID NO: 1408646 - protein, 9 aa, Homo Sapiens
PFSCTLKRW

SEQ ID NO: 1408647 - protein, 9 aa, Homo Sapiens
RSCKKVTIC

SEQ ID NO: 1408648 - protein, 9 aa, Homo Sapiens
AGTVKDIVT

SEQ ID NO: 1408649 - protein, 9 aa, Homo Sapiens
PTVDRTLCC

SEQ ID NO: 1408650 - protein, 9 aa, Homo Sapiens
EEEKGNQET

SEQ ID NO: 1408651 - protein, 9 aa, Homo Sapiens
IIPRGWGLL

SEQ ID NO: 1408652 - protein, 9 aa, Homo Sapiens
VDAAPPVGL

SEQ ID NO: 1408653 - protein, 9 aa, Homo Sapiens
KEFVEKKFK

SEQ ID NO: 1408654 - protein, 9 aa, Homo Sapiens
SPRPTDNCF

SEQ ID NO: 1408655 - protein, 9 aa, Homo Sapiens
TSWARTGES

SEQ ID NO: 1408656 - protein, 9 aa, Homo Sapiens
ATHLPVTDT

SEQ ID NO: 1408657 - protein, 9 aa, Homo Sapiens
NLFSIMLGS

SEQ ID NO: 1408658 - protein, 9 aa, Homo Sapiens
AAVSVSTDT

SEQ ID NO: 1408659 - protein, 9 aa, Homo Sapiens
VTICMTIRK

SEQ ID NO: 1408660 - protein, 9 aa, Homo Sapiens
TIPDNDNER

SEQ ID NO: 1408661 - protein, 9 aa, Homo Sapiens
RGVILFPDI

SEQ ID NO: 1408662 - protein, 9 aa, Homo Sapiens
QFESARGVI

SEQ ID NO: 1408663 - protein, 9 aa, Homo Sapiens
QETQMAKEA

SEQ ID NO: 1408664 - protein, 9 aa, Homo Sapiens
ILAGTVKDI

SEQ ID NO: 1408665 - protein, 9 aa, Homo Sapiens
SKKLTMKFP

SEQ ID NO: 1408666 - protein, 9 aa, Homo Sapiens
SMKITQVTW

SEQ ID NO: 1408667 - protein, 9 aa, Homo Sapiens
LRNIIQETQ

SEQ ID NO: 1408668 - protein, 9 aa, Homo Sapiens
KGNQETAEF

SEQ ID NO: 1408669 - protein, 9 aa, Homo Sapiens
KVPMADKPS

SEQ ID NO: 1408670 - protein, 9 aa, Homo Sapiens
PDNDNERLS

SEQ ID NO: 1408671 - protein, 9 aa, Homo Sapiens
DCRCRSRLF

SEQ ID NO: 1408672 - protein, 9 aa, Homo Sapiens
REQQQQQPL

SEQ ID NO: 1408673 - protein, 9 aa, Homo Sapiens
EYLLSLKFF

SEQ ID NO: 1408674 - protein, 9 aa, Homo Sapiens
GLTRVLEEM

SEQ ID NO: 1408675 - protein, 9 aa, Homo Sapiens
SLEDQGIFQ

SEQ ID NO: 1408676 - protein, 9 aa, Homo Sapiens
VDRMKKDQE

SEQ ID NO: 1408677 - protein, 9 aa, Homo Sapiens
NPLPSMKIT

SEQ ID NO: 1408678 - protein, 9 aa, Homo Sapiens
TNGSQFFMC

SEQ ID NO: 1408679 - protein, 9 aa, Homo Sapiens
KKRQEVLEM

SEQ ID NO: 1408680 - protein, 9 aa, Homo Sapiens
EQILRNIIQ

SEQ ID NO: 1408681 - protein, 9 aa, Homo Sapiens
DSKIHKDSL

SEQ ID NO: 1408682 - protein, 9 aa, Homo Sapiens
QESQETQIS

SEQ ID NO: 1408683 - protein, 9 aa, Homo Sapiens
AWSQDTGDD

SEQ ID NO: 1408684 - protein, 9 aa, Homo Sapiens
MWRLPFSCT

SEQ ID NO: 1408685 - protein, 9 aa, Homo Sapiens
IFVLLLSAI

SEQ ID NO: 1408686 - protein, 9 aa, Homo Sapiens
RWATISLSD

SEQ ID NO: 1408687 - protein, 9 aa, Homo Sapiens
DGRWATISL

SEQ ID NO: 1408688 - protein, 9 aa, Homo Sapiens
QGQLPDTES

SEQ ID NO: 1408689 - protein, 9 aa, Homo Sapiens
SLKSQVIFL

SEQ ID NO: 1408690 - protein, 9 aa, Homo Sapiens
ESDGIVVSK

SEQ ID NO: 1408691 - protein, 9 aa, Homo Sapiens
LKDCRCRSR

SEQ ID NO: 1408692 - protein, 9 aa, Homo Sapiens
LCCFVPENM

SEQ ID NO: 1408693 - protein, 9 aa, Homo Sapiens
PPVPPLGLQ

SEQ ID NO: 1408694 - protein, 9 aa, Homo Sapiens
GWWPALSRT

SEQ ID NO: 1408695 - protein, 9 aa, Homo Sapiens
RPTDNCFSS

SEQ ID NO: 1408696 - protein, 9 aa, Homo Sapiens
VILFKVLLT

SEQ ID NO: 1408697 - protein, 9 aa, Homo Sapiens
KKGEKYAVP

SEQ ID NO: 1408698 - protein, 9 aa, Homo Sapiens
QVIVQCCLS

SEQ ID NO: 1408699 - protein, 9 aa, Homo Sapiens
DQGWDPNVN

SEQ ID NO: 1408700 - protein, 9 aa, Homo Sapiens
YKIEWQKGA

SEQ ID NO: 1408701 - protein, 9 aa, Homo Sapiens
PNTVFKLKQ

SEQ ID NO: 1408702 - protein, 9 aa, Homo Sapiens
TGLQCSPTR

SEQ ID NO: 1408703 - protein, 9 aa, Homo Sapiens
ETQISNHLD

SEQ ID NO: 1408704 - protein, 9 aa, Homo Sapiens
SQDTGDDNT

SEQ ID NO: 1408705 - protein, 9 aa, Homo Sapiens
VEKKFKEVA

SEQ ID NO: 1408706 - protein, 9 aa, Homo Sapiens
TQISNHLDE

SEQ ID NO: 1408707 - protein, 9 aa, Homo Sapiens
YSPRPTDNC

SEQ ID NO: 1408708 - protein, 9 aa, Homo Sapiens
DGIVVSKDT

SEQ ID NO: 1408709 - protein, 9 aa, Homo Sapiens
QHLGLALDV

SEQ ID NO: 1408710 - protein, 9 aa, Homo Sapiens
MDRGRIAER

SEQ ID NO: 1408711 - protein, 9 aa, Homo Sapiens
PSHAARESL

SEQ ID NO: 1408712 - protein, 9 aa, Homo Sapiens
GCKKKTISY

SEQ ID NO: 1408713 - protein, 9 aa, Homo Sapiens
GIFQNGIES

SEQ ID NO: 1408714 - protein, 9 aa, Homo Sapiens
WIIPRGWGL

SEQ ID NO: 1408715 - protein, 9 aa, Homo Sapiens
FESARGVIL

SEQ ID NO: 1408716 - protein, 9 aa, Homo Sapiens
GRWATISLS

SEQ ID NO: 1408717 - protein, 9 aa, Homo Sapiens
QESCCSPSC

SEQ ID NO: 1408718 - protein, 9 aa, Homo Sapiens
IIREHLWNS

SEQ ID NO: 1408719 - protein, 9 aa, Homo Sapiens
LKLAPLQVT

SEQ ID NO: 1408720 - protein, 9 aa, Homo Sapiens
ILFPDIKIV

SEQ ID NO: 1408721 - protein, 9 aa, Homo Sapiens
VQCCLSAKN

SEQ ID NO: 1408722 - protein, 9 aa, Homo Sapiens
LTAGLRRLV

SEQ ID NO: 1408723 - protein, 9 aa, Homo Sapiens
AHGESSLAS

SEQ ID NO: 1408724 - protein, 9 aa, Homo Sapiens
FHYSYTASS

SEQ ID NO: 1408725 - protein, 9 aa, Homo Sapiens
GDTPRMREI

SEQ ID NO: 1408726 - protein, 9 aa, Homo Sapiens
VTLCMFRPC

SEQ ID NO: 1408727 - protein, 9 aa, Homo Sapiens
LFINLFSIM

SEQ ID NO: 1408728 - protein, 9 aa, Homo Sapiens
VIFLQKRAS

SEQ ID NO: 1408729 - protein, 9 aa, Homo Sapiens
SFHISADRM
